United States Patent 9,567,581 (SELECTIVE REACTIVATION OF GENES ON THE INACTIVE X CHROMOSOME) - sequence listing, part 29

SEQ ID NO: 3568 - DNA, 60802 bp, human
agagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaaga

SEQ ID NO: 3569 - DNA, 60192 bp, human
aagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccat

SEQ ID NO: 3570 - DNA, 61444 bp, human
gctgctctatttcaaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatg

SEQ ID NO: 3571 - DNA, 61152 bp, human
agggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacagg

SEQ ID NO: 3572 - DNA, 62764 bp, human; identical to SEQ ID NO: 3562

SEQ ID NO: 3573 - DNA, 62563 bp, human; identical to SEQ ID NO: 3563

SEQ ID NO: 3574 - DNA, 61676 bp, human; identical to SEQ ID NO: 3564

SEQ ID NO: 3575 - DNA, 62764 bp, human; identical to SEQ ID NO: 3565

SEQ ID NO: 3576 - DNA, 62697 bp, human; identical to SEQ ID NO: 3566

SEQ ID NO: 3577 - DNA, 62591 bp, human; identical to SEQ ID NO: 3567

SEQ ID NO: 3578 - DNA, 60802 bp, human; identical to SEQ ID NO: 3568

SEQ ID NO: 3579 - DNA, 60192 bp, human; identical to SEQ ID NO: 3569

SEQ ID NO: 3580 - DNA, 61444 bp, human; identical to SEQ ID NO: 3570

SEQ ID NO: 3581 - DNA, 61152 bp, human; identical to SEQ ID NO: 3571

SEQ ID NO: 3582 - DNA, 1140 bp, human
gcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctcca

SEQ ID NO: 3583 - DNA, 16726 bp, human
ggccctgtgggtcctatatgtgccctgcaacttggggaaaatggaggtggggttgtggtctctatgctgtagcagccggaaagccaaaaacaagccgtacttctcgctcttgacaggatcccaaggtcagaggtgaaagaggtgctgggggtcactgaccatacctgcaaaactgagagtatggtcctttcgttctaacagactgctgaggagtctctatttctcctctcaaaagcaaaccctttagatgtattaatttccctttttcttcttcttcgctttttttttttttaaatgttcttgggtaaaagccagaggaggtagtagaatatgaaatttcatctgcattgtgtagacttatagtctactaaattgttttgtaattacagtgtttatgttttttcctcttgtttataattatttcatgttaaacgttatagcaaaatatattagacccataaatgtttatttaagttgtgttttgtgaactgctgggacttttgtttctatatttgcctgagtccttttatctttgtgcataaccttgggatgaggccctggtagaagtatttccttcttggcatttggcaccattaaactcaagattctgtccccttgacatttcccttgttgtagtccttgctctcaagcagtattgttaataattcagtacagctttccatactatatccaggttgatcaagagtaaatataattgagatataaaaaaactacatagttcagagatagagttcaggagctggtatgtatttgcatacaagtccagcttgtattgacatattgcacacctcctcaggagaaggctgactgggcagggccaccttggctcccttctgtgaagccttgctttgctgacatatattgcgttggatggagagactccaagcagcaaaacgttttgcataaactaagaaagcggaggggggcccccacttccagacagagctggtagctttctgggtggagcagaaagagggtataaggggcatctctttcttggatgaactcattcaacagtcactgtgtgcttgtcctgtgtcaggtatagtgtaagtggggattcagaggtaaacaaaacaggacaaactcccaaagacttcatggtctagctgcagaaacagagctgcagacagacaaaaacagtacaaatactaagtggtaatggaggcctggtgtgtgtagggggaatagggggtggcatgtcttgggtgtggaggaggggttagctctggcagaagagaaggacaatctaggtagagagactagagagactagtgaacagaggcttggggctgagaacagtgtgtatgctgatatccgggtgtggattacaaagcagttcagtgttactggagaataaaatgtgagacatggaagctggtatagttatagaagtgcttgttattaatgtaataaataacaatatatagaaacaactctcataaccatggcaagttgaaagtaatgataattgtaaacatatttaaagatacctgtagtaacagtaatgtgacataaaattgtgatttctattggggacaaagtcacaggtaccactaacactatcgtgatctgttctctgcatttgtagttgaaggaaatctaaattttagttagaggttggtgaaaacaaagatgtaatattttcccatctaagttaatttatcccctgaatatttatttatttacttttttagaacgagtcttgcttttgttgcccaggccagacaatggtgcgattttaactcactgcaacctccacctcccaggttcaagcgattctccttcctcagcctcccaagtagctgggattacgggcatgtgccaccacacagggctaattttgtatttttagtagagacagggtttcgccacattggccaagctggtttggaacctctgacctcaggtgatccacccgcttcggcctcctaaagtgctgggattacaggcgtgagccaccgtgcccagcctatcccctgaattttttttttttttttttttttttgagacagagtctcgctctgtcgcccaggctggagtgcagtggtgcgatcttggctcatgcaagctccacctcccgggttcacgccattctcctgcctcagcctcccgagtagctgggactacaggtgcctgctaccacgcccggctaatttttttgtatttttagtagagacgaggtttcaccatgttagcgaggatggtcttgatctcctgacctcgtgatccgcccgtctcggcctcccaaagtgctgggattacaggcgtgagccaccgcgcccagcctcccctgaatttttaggggtccctgttctaaggccaggtgctgtggcccatgcctataatcccagcactttgagaggccggggtgggcggatcccttgaggccaggatttcaagaccagcctgggccacacggcaaaacactatctctacaaaaagtacaaaaattccctgggcatgctagcgtgcatctgtagtcccagctacgcagggaggatcacctgagcccgggtaggttgagactgcagtgagccattattgctccactgcactccagcctgggagaagagttctagaccaacctccttatatatattaataacaatattagatgaatgagtctttactatatgccaagcactgtgctaaaacctttatagtcattttctactgattcatcatcacaagcctgtgaggcagccttgttttcatagctctcggagacatggaattgttttctaaggttacacagctggcaaggggcagaaatgggacttgaccctgagtcagtgtcacttaagccccacccaaacttcaggccttggatctgcaccaggatggctacattagaatcacctgggaagttcacttttttttttttttttttttgacagagtcttgcttggtcaccaaggctggagtgcagtgccacaatctcggctcactgcaacctctgcctcccgggttcgagcgattcttgtgcttcagcctcccgagtagctgggattacagacacatgccaccatgcagggctcatttttgtatttttagtagagacggggttgctccatgttgcccaggctggtcttgaactcctgagcttaagatccacccgtcttggcctcccgaagttctgggattacaggagccaccaagcccggccttattattattataattattgagacagggtcttgctctgttgcccagagctggagtgcagtggtacaatctcagctcactacagtctcgacctcctgggctccaggggtcctcctgcctcagccttctgagtagctgggactgcaagggtgtgctaccacgcccagctaaattttgtagagacgaggtctcgccattttgcccaggctggtctcaaactcctggctcaagcaatctgcctgccttgggcttcccatagtgctgggattacaggcatgagccatgaaggccggcttttttttttttttttttggacagtatttggctctgccgcccaggctggggtgcagtggcacgatctcggctcactgcagccttggcctgcctgcctgcctgaaggggtcctcccaactcagccttctgagtagctgggactacaggcgtgcaatctctcctcactgctacctccgcctcccgggttcaagcgatcctctcatctcagtgtcccgagtagctgggactacaggtgagtaccaccacgcccggctaatttttttttttttttttttttgtggagatggggctttatcatgttgctcaggcaggttttgaactcctgagctcaagcaatccgcctgccttggcctcccaaggtgctgggattacaggcgtgagccaccacacccagcctgggatccatctatcattctatctatctatctatctatcatctatctatctatctatctatctatctctctctctctctctatatatatatatatatagatctatagatatctatagatctatatatagatatctatatatagatctatagatatctatatatatagatctatagatatctatatttatatatagatatctagatatctatatatagagagatatatatatttatatatatatatttttttctttgagacggagtctcgctctgtctaattttggtatttttagtagagacagggtttcaccatgttggccaggctagtctcaatctcctgacctgaggtgatctgcccacctcggcttcccaaagtgctgggattacaggtgtgagccactgcactgggcagagatctatacttttaaaagatccccagatgattcttaaaggtagccaggtttgggagctttaatgttctcaaccacaaactttttgtttttattttacattttaattgaaattgtatatatttaaggtgtacatcacggctatatatatatatataaatatatatatataaatatatatatataaatatatatataaatatatatatataaatatatatatataaatatatatataaatatatatatataaatatatataaatatatatatataaatatatatataaatatatatatataaatatatatataaatatatatatataaatatatatatatataaatatatatatatatatacccacacatatatacacacatagactacagtcaagctaacatatccatctcttcacatagttatctttgtgtgtgtgtgcgtctgtgtgcagtgagatctacgctattagcaaatttcaagtgaacaatacagtattgttaactatagtcaccatgctgtacattacatctctagaacttattcatcccatgtaactgaagctttgaaccctttgaccaacatctcccaatgtgttccccacccaacccctggtaaccaccatctactctctgctttgatgaattcagtttttttagattccacatataagtgagatcatgtagtgtttttttttctgtgtttggcttatttcacttagcaaaatatcctccaggatcattcatgttatcacaaatggcaggatttcctactaaggctaaataatattttattttatatatacatatacatatatacacataatatacacacatatatacacataatatacatatatacacatatatatacactcatatacacatacatatacacatatgcacacacatacatgtgtgtatatatatatatacacaccccacaatttctatatttagaaattgaatttttttagaaaaaattaggaattcatttagaaattgaaatgaatggataaaaactcatttttatctatcaatggacacttaggcagtttccacaagctttcttagcacagttcttgggcatggtagatacctaataaatatctgattaaccaaggggaaataaaatatggagatggggaactgagggaaattgaaaagctgtcctcgagggccaggcacagtggctcacgcctgtaattctagcactttgggaggccgaggcagtgggatcacttgaggtcaggaatttgagacaagcctggccaacagggtgaaatcctgtctctactacaaatataaaaattagcctggcatggtggcacttgcctttttttttttttttttttttattttttattttagagggagtctcactctgtcgcccaggctggaatgcagtggcgcgatctccgctcactgcagcttctgcctcccggattcaagcgattctcttgcctcagcctcccgagtagctgaaattacaggcacctgccaccatgcccagctagtttttgtatttttagtagagacagggtttcaccatgttggccaggctggtcttgaactcctgacttcaagtgatccatctgcctcggcctcccaaagtgctgggattacagacgtgagccactgcacccggccaagaattgtatatatttaaggtgtacaccatgatgttttgacatacattgtgaaacgattaccacaatcaagctaattaacatatacatcaacctgtctttgtagaactgtttcatggaggccatatattattacatcctaatatctacagtgttttcttctggagctcacagtctggtgtgcgtatgtgtgtgtgtgtgtgtgtgtgtgtgtgtgtgtccagggtgggagcacaggcaagtaaagagacaatcacagtatatatgataaggattgtcatggaatgaagcacagaatggtgatggaaggaacaaagagtgggcataccaaacacagattggaagggtaaaggaaggcttcctagaggagatgatggcttgaaggatgaattgagaaggacaaagtacttatccaagcccatttttagtgcctagtaggcattcatctaatgagatggtggatgtataacacttggtacctaccacatagtcacaactcaatatgtggtagatgtcattattgttacctgaccttttcaaacaaacttgaatggcaagttatgtttactatgaggagtatgtaagataatgcatgacatgttaagtacttaatatagtgtctggcatataataattgcccagcaactggtggcagttgatagtgttattgttgctgctatcattatttttaggtttggctggactgagatagatggaatcttccatctctgatcttttgggtcattcaactctgcaatttgttacatgttacattatttcatattacatgaaattacatattacatatttatatatgtaatatgaaattacatgttacacattacattttttcagatataatgtctgcaagcatgcttatgttcagaacttttcccgataacaatctctggccccaaccataacaatctctggccccaaccaccgctaccaccatcaccagccacatggtgttctcaagttgtggtctccacaaagcatataggaaatagaggagctgggcagatgcggtggctcacgcctgtaattccaacactttgggaagctgaggcgggtggatcacttaagctcaggagttcaagaccagcctgggcaacatggcaaaaccccatctccacaaaaaaaaaaaaaaaaaaaaaaatagccaggtgtggtggcatgcacctgtggtttcagctactcaggaggctgaggtgggaagattgcttgagcctgggaggttgaggctgtagtgagctgtgattgtgccactgcactccagcctgggccacagaatgagaccttgtctcaaaaacaaacaaaagaaagaaggaaggaaagaaagaaggaaggaaggaaggaaggaaggaaagaaagaaagaaggaaagaaagaaaggaaggaaggaaggagaaagaaagaaagagaaaaaaataaaatagaggaattgatggtagaagaagtggaacagagctgttgttgcctctgaaaatattttctttatagtaaagggatgacattggttttctgatgagcctctgtatttccaatctaaggacagttggtagaagtgaatcaaaatctttccccaactttgttgggcacttttgctgttctggataggagggtagagtgtatgtagattataaatatgttcctcagtccaaccccatctccctacaacagctagcagaaattccttctccattagcaattaacagtcccttttcccctattttccgtagctagtgcaagttttagttttttgttgcaaagcttcatggatattttaatgggcattcctagatggtgggtatcagactgtgttatcttgctgccatgttaacccagagttcccccagatacaattggttttcttgctaacaacttcagggagaaggcacaaaagtcctttgctttttcatggtcctttcttactgtctttccagccctctccatcctgggggccctgttttcaccagtcatcttattttacccaatacaggagtcctcatcctttttgtaaggaaaaactgtgttgtatattcctgatgccttgatctccctgggaagacggaaattaaaggtagagggaagtttactgaatctgggggctggctaccagggtgtgggagtgaagaggattggggagatgctgcttactgtcttcctctctgagctgagaatccaggtaaactgcagagagcagggcaggagaagggcgatcatgttggagagttagcttgcaaggccttgatattgtttgtagatcccaagctaccgattaggggcccctgacctaatatagtaaaaaaaaaaatggtttgtgttgtcattgtggctattttttaatatccttccagaggtatatctcccttcctgtattagctttctaaatcttgatactgtgcacgcagattgatccatttgccctactttccactccttgtagcattgtcaattgtctttcagccacctctggaattctggacttggtttacctagcctttgtgaccactccatatattgacatacagggagcctccaagctgcagacaggctgagctctcaaagttcactctcaagtcaattgtttggaaggtgacatgcatttttccataggagaaaaaaattgttataaattgaactacatttccagaccagcccacaaaagatgtttttagctttaatgtactaaaaatgtgggccatttgcaatgacaaagtaggaaatcttggtaattcagcaaaaacaagaagacaatccaagggaataagaaatacttttgcttgactgctggtactggagtcaagaaagctgaactggatgaggtacacagggctttccggaggctctccagaaagactcatggggactttgaaagtctggaatcataacatagttctaagtttacttcagaactgatggctttcaataataatgactaccacatactgagcacttactgtgtgtcaggcgctgtgttaggcagtttacataccttcccctcatttcatttcattctcacaacaacactatgaggtaaatactataatgacccttattttacagactgaggctcagaagggtcaaggaacttgacaaaagttatacagacagcacaattagaggccaagtcaatggtttcctactgcccaaacctgtgctttacaatatatatctgaccactcttttcttttcttttctttatctggatatattgggaacactacttttggggctatcagccatgattagagttatgtgccagatcacaaggaaactaagattgggaaactaggagaggtggtacaagggagagaaggaaggaggaagggacagagaattttgttaggcaaaagttcaactaagaaaccacatacgtcagtgcttctcaaactgtactgtgcactcaaatcacctgaaactcgttaaaatgaagattattattcagcagatctagggaggggcctgagatcctgcatttctaaaaagctcccaggtgtgctgctcctgctggcccacggacaacactttgaacagtaaggccatatagtgcaaatgataaacaaaaaaattcaagcatccattaacacctgcttcctaatttaatccagatcagcttctacactaaacagtcacttattatcctcttttctcctgtagcctgtctcaggccattgtctccgctttagttctgccagtctgtttcagcttatgtttgtttatttatttatttgtacaaatttaaggggttcgagtgcagttttggtacatggatatattgcagagtggtgaagtctgggcttttaatgtaaccgtcacccaaacagtgtagattgtacccattaagtaatttctcatctctcacctccatgacatgtttatgtttaactactcatttaaatacaggtgttaaatacatatgaacatcttctgtcactctgagcactaggcagtctcaatcagacatgaatttctcttggcacaaagtagatatttggccacagggttccagtcctcaacaatggctctcagctctctcacccattaggaacagtcttataaaggtaaggcatgtagtaacactactgtcccagcgctttctaatttcctttcttagagctactgccttcatctggagcagaaagtagcctggctttttaaagagtccagatccttgttcctttcacatagttgaaacaatcccagcattagtttaaggcaaccattgaaaagattctttgcagagtcctgccaactccaaaagcccagtgaagtttgtttcctggaagataatttactttattttgccacctcctctcctccgtcctcttaggattttgactgatcattttgagccattcttcatgtttttcttctatttttagactctctgactaattttctccagtagcaagagtcaaggaaagctttccactccaaccaagctctactttttaggtaggaaatattctctcacagtgtttacagatcaacttggtgatctgtggtccctggcaactggattgcttttctatcttctctttaacctttggggatgttaaccttgggggtgacccttctaacacctttagcaggtaggtgttcattgcagcctccacatgaatagattaggtaagttcacattctatcactggatgaattaaaaactctgctaaaaaagaattgtaatcttctgtttttaacttctatccattaatcttacttttatcatatggagcagaaatagcactttcaatatttcaagacatttgtcatatcctcctttaaccatctctttgctagactaaacatccccaatttctaatcagtcctcagttacttcttgacccttcattcattcaataaacatcagatgcactatgatttgtaaatgttcactttaaaatacagtacctcgaaatggaacgtagtgctcgctgtgtagtttgaccagcatggagcacattgggactgccactccttgtgatggtctgatgcaatttcatgatcataccagcttaaaaaagagtaactcacttcttcacatctagtgagtacctactttgggtcaggtacctaacatcaactagaaacctctgttttcagtggtagaggttctctgttctttcttaccccatggggcctggagatggtacagccaccctcttccaatccttcctactatcatctgctgtactttagttctctcacctattgaggacttcacctcctcactgatagtcttcctttccaccccaactctagccaccatcctgagtgatcttaatgtcctcatagatgacccatttataagcttcatcctttcaatcattttacctccactctgcttcaccaactattttcaatgatccactttattctcagcagatgatctcacctcttattccattatgaaaatctaggtcgttggatgctaacactcattttcctgtcctaaccccaccctgccacatagttgtgtccctacatgtcctaacctctttttttttttttttttttttttgggcttgcagaaatacacatagcttctccagttcaaggctaatttctctacgtatgctttggagcccattctttctcacctccatgaggacttacttcatcagttatccctcctctcatctgtgtcttcaacaactccttctctacttactggctgcttcccatcaaccttcaggcatgatcaactttcactctaaaaaaagaaacaaacaaattttccttcgcctctatccccaactggcatttgccctatttctcttcttttattgttatggaatcttttctaaagtgtagacactctccatttcctcacctcctgttaaaaactcagctcccactatggcttttctgttcccagaacaccactgttatttctcttttaagtaaaccaatgacatcctaattgccaaatctaatgaacaatgttaagtctttattttactggacctctctctgatgtatttaacataattgattgctctcaccctacttctgtcctcatgactctcatgacctactccttggctttggtgatgttgcacatcttctgactgtcctcattcctctctgattactccttcttatgctgttttgtggacttttcgtctgccaccccttaaatgccagtctttcccaggttttttcattcctcacctttcccctagatcatctcatccatacccatggttttatctaccatcctattgagccccaaatctgtgtctgtggtcccagacacagacctctcttgagagctccaaacccatatactagttaatacttgacacgtgtaatatggcacatcctacaggtacctcaagaccaaactcagtatgttccaaattcatcttttttattccaatctgcccttcctcctctgtctgcccaactgacaccattttggtgactcagacctctatctacacagttgacctctatctacacagtgctgaaactcggtagtcatcctgaatttctcattcaaccagtcaccaagacctgttcagtctgtcttctaagtatctatctgagatgtgtttcctttatgttactacagcatattattagtccaggctttccataatctttttgttttttaaccattcaaatagctccgtaactggtcttcctgcctcttggcctgctcccccttagtctatccttcacactgtgatagaatgcattttctctaatgcaaatcagatcacatcactcctctgcttgaagccctatcatggttcccactgcttactggtacagtccaagctgctccacaaggcttacaaggcccctcacaatctggccttgcctacccttccaatcttatctcctatcatcttttccttattttctttgcccaaataacgtcagactgaacaccccccatcacgccttcatgccttcatacacactgttctctctgcctagaatgaccccttggtcttccagtcaaatctttattcagctttcaaaattggactcagactatgtctgggtagatacacaagaaactagtgacaatgattgggtggctggggcacaggagtgggaagaagacttcctttttccacctatttgtacattctgcattttgtaacacaaatctgaattcactattcaaaaaagtaaatactacgtaaattttttgttaaaaaagctcaggaatcaggtcctttagaaagttgttttcccctcctcatcctcctctgtagttttgtactcccttctttgtgctacctctgggcctactgtgtgctcctgtgattagaataattacattgcattgcaatttgtatgttaagttgtccatctccccagattgtgagctacctgagggaaagggctgcatcttactttttattgtttccccagaatttaacatagtgctctataaatgttgattgaatgaatggagaaacaagtgaagagaagaataaagtagaggatgccccacattataaaacaaagctcccatgccagttatctttcccaatatccatcaatctgtccttttgccacgtgttgagcttgaaagtaatactttacatttatacttttttttttttctgagacagggtctcactctgtcacccaggctggagtgcaatggcacaattatggctcacttcagcctcgatctcctgggctctagatcctcctacctcagccttccaagtagctgggactatagtcacatgccaccacgccatgctaatatttgtaatctgttgtaaagatgaggtttcaccatgttgcccaggctggtcttgaactcctgggattaagcaatccacctgcctcggcctcccaaagtgctgggattgcaggcgtgagccactgcacccggccttacatttattcttaagtactatccatcaattatcttgtcaatttgggctcagcatcatgtaagactgcccagatcatttcaaagtccctcttatttttgtgttatgtgtagatttgatatgtatttgtatatcctattttgaatcacttgatcagaatattgatacaatacctattgcttattgaacacctacagtgtgtcaaacactgtgctgggtgtttttacatatgacattgtcacagtatttgttgcaagataggtattttgctctccagtttacagatgagaagattgaaatcagtattgttaagtgccctgcctagggtcatattgctagtaaatggtgaagttgagatttgaaccaaggtcttttgacttcaaaattcatgcttgagtcataacactacattgattcaaaggggcatctccactgcttcactactgggtgcctagctcaaggcagcccattgtctttggactgctctgaccattttaaaagctcttgtttgtagtgagccaagttataaatgagccaaacaagacatggccaataacagagcctttggctctctgctagaaccttccttccagtctgacaccaaaccatgtgttcgcttctttggctatagttgttcaactagttataggctcatctcaacaaatgcctgaagcatccagcttatattttgccatctcatctacaaggaaattatggcaaactttgtccaatgcctggatgaaatgaaatccactatagctatcacattctctggtagcttatctagtaaccagatcaaaaaaaaaaaaaaaggaaatgaagtctaggagggatatttgttttttaacggggcaatttgtcaatgacttaaagtaatgagtttccagtggtatactttcagacatccttgacaggctgtcaggaagatgatttttggccagtgggcttcctacttctcttcaaatgacatctaaatagggactcccattttcattgctttgaattgcacagcactgttgtttacatctggttttatttaatcttccatttcagttttctgggcttttattttttctttgtgttctgcccttgcacatgttccctctgcctggttcattccctaaactcctacaccccccagccctgcaacacacacatatacataccttccttgtcctttgagaatcagtgcatgcagtcccttctccagaagccttctctgttgtccccaggctgaggtaactgcttctcctcttgggtgttgtagtggcaagtgagcacagtgcctgtcacaaagtagatccccaataaatgttaactcccttctccccttcctccatgaatatctctaaaatagtattgattacaccatattgtattttcatgtttacttgtttgccttcatcactcaattatgagctcattcattcatccagtcattaacaaatatttattgtgtgtctaaggtgtacaaggcattgttcatgtaggtactggggacacagtgatttctgaaaattgtattttcactgtgtcttttcattgttgtacttatagcacctgtcatagtgtctggcaagtagagtgcttattaaatgtttgttaagggaatgcacttccttagcagagtttctcaaagtgtaatctttggaccatttgcatctggatcattgaggggtgtaggttaaaatgttaattcttgggtccctctccaaacctactgaatcagaatatcttaagagtgggctgcaagaatctgtattttaatctcgttttgcggtgtttctatcatgctaaaatttgggaacctctgcgaaacagaatagaaatagggagacccagtgcctccctatatatgcctccctataataacattgaaaagtgtagctaaaaccgactaaatcgtgtttaatgcctccgaatgctgcagtaaattttagtaaaagagaaaaaggaattaattaaaattgtctagaaaggttaattactatttaccttttgaacaagtggaattattgccaataaaatctaatcttaatttaggtcaaatttatgataccagagagttttcatttctaaagtgctacttgtatatttgatggtatatagggacccattgtgtaacccaacaatacaatatattgattccatgttatagacttgaattgcaaattaagaaagagtatgtccaaactgtacttgtgctttaacattgattatatatgtgatttatctgatgcttagtccttaatcagaattgttagtgctcattctctgtgcaaatttgatccatttaactgttttatgccatattttccaagaacatgctgttattaaaagtgctctttggtaatagatcaggcatataagatctaagtctcaaccaaagacagcacaacttccctttcaggaagacttgacaaattggattttatgaccatgttttggggattggagctgtctatttttagtgtgccttgacatgatccttatggtcaggagctgaagtgttcttgtatctgaacacaaatatgttaaatattcacaggtttatacttctgtttccctccttttgacttccctctttttttcaactcaacttaggttttcagtggtggtgtcactgctgccaagctggaccgaaaacggccatcggcatgctgcccaaccagcaccatgtccaaagacctgaaaattctatgtaaagaccctgctttggagctgagctgctaccgggaccatcagttcagtggccgtaaatttcagcaggaaaaattactgaaggaaagctccacattgaatatggggaatctttccttttatacaaccgaagagaaaatacatgaactctttagtagatctgatatcaggaatatctttatgggcctggataaaataaagaaaacagcatgtgg

SEQ ID NO: 3584 - DNA, 62764 bp, human; identical to SEQ ID NO: 3562

SEQ ID NO: 3585 - DNA, 2170 bp, human
tctatttcaaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctg

SEQ ID NO: 3586 - DNA, 62563 bp, human; identical to SEQ ID NO: 3563

SEQ ID NO: 3587 - DNA, 61676 bp, human; identical to SEQ ID NO: 3564

SEQ ID NO: 3588 - DNA, 62764 bp, human; identical to SEQ ID NO: 3565

SEQ ID NO: 3589 - DNA, 62697 bp, human; identical to SEQ ID NO: 3566

SEQ ID NO: 3590 - DNA, 62591 bp, human; identical to SEQ ID NO: 3567

SEQ ID NO: 3591 - DNA, 2083 bp, human
aaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttga

SEQ ID NO: 3592 - DNA, 60802 bp, human; identical to SEQ ID NO: 3568

SEQ ID NO: 3593 - DNA, 60192 bp, human; identical to SEQ ID NO: 3569

SEQ ID NO: 3594 - DNA, 61444 bp, human; identical to SEQ ID NO: 3570

SEQ ID NO: 3595 - DNA, 61152 bp, human; identical to SEQ ID NO: 3571

SEQ ID NO: 3596 - DNA, 15626 bp, human
ttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaact

SEQ ID NO: 3597 - DNA, 100779 bp, human
cctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcagatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatcggtaatttttggagaaagaaagccagattttgaatagttcccctttcatattttaggaaatgtgcagaaaattctgattataaattaagtggaaactatttttactcatttttggatggagagtggaaaatgaatcattcccaactgtgtggttcgttatgttgtctgaaacatcttggactttggggaggtgagagaggtactggttgtgtgtgtgttgcgggggtggaggggtcactttggtttggtgccaagtgtaaaagaatattaattctccatgttaagcagagagaaagtctgacttttagtgtcacatatactcacttctttgggttaattttaaattggaaaatcatttaggattacccccttagtctgcttgattcttccccaaggagaaagggagaaagttggctggcaggagctatgggagagtctgcctgagtatattcccctggccctggccctgagagaagcacaggagtcctgtaggagatatatactataccctatcattcttccccatactatcattcttcccctgtatctaggaggttggctttttagccagtatctgataacagggtttatttttactttttggttctggaacttcactgttgacatttgtaactactttttatatacgaacctccctgattaggattagtggcttctaatatttatttgttcaataaagaataaataaaccattatgttatagatgaaaagtcagaataaccagaaactagcctgtctttttaacatgttctcaaagtggattagagggcttggggtacttagtttagtttcatgatcttatttagttgtccagtctaccaatagggttgagacgcaggacacatgtctttcagcaggctaccagtagttcaattaattattcaattttaaataatatttttattcacgacagttattagagcagtaagtcctatcagagtaattattttctccatcacctctcacttttcactcactagtcccaatatatatcttagttcatgatatatggggcatttctataaaacggcttcatattttagaattttcattatcacatgagtttccatccttataaaagattgttgttatcgttttaataaattttggcttcataaaagaggccaaatttcggtgactgtctattgctgatagacttcaactcaatattataagtcccatacaacttttttcttgtgctgcccatgtattttcccctctactcctctaaaacatgctaccttcatctaccccagtgagcctcctgtctgcaaaatataccattctcttttctgattcttaactgtcactagtgttcttctcttggcctgtttacaaatcctacgtattctttaatgcataattcaaaccccataagaccactccaaaacatcacagctacgtcataatctccttcaggtcagaaataatgtcttgtatttctttagtattctccttagtttctagtacacatagtattttctcaagaaatccaaatgaattcagtcttcataatggatttgcaggaaatataccagtgcctatagcttgctttggatctcatctaagaagatataaatctgtcttgccattatatataccctgaaagtctgaaaaaagatctcctgtgaactactgacaatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagggtgggttaccataggtgagggaaaagaaaaatgttgtttctcactctcagtcaggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgccatgacagaggtttgcacaggatgctctgaagcacagtggaggggtcagggaaaggatatcattgagttcaaaaacagggaatcatgagtgaatttattggagaagaaggaccaaaccggagagagtccatgcggaaagaattgacaaaacttggtgaatgactatgatgattatacaccatgaagagaatgaattaaaaaggacttttgaggtggagatgtcttgaaggatggtggtattgaggaggacaaaaatgaaattaggaaggggtggcagttttttggggatgctttgactttagatttgagtctgatgtgattgtgggtcatttaacaatcattcattcatcaaacatttcttgaacatctattaggtggcaagcacccggataggtattagggttacagtgattaagaaagcacagcctcaaccctgatggagctctcaggttagtgtggggaggcagataattaaggacacagttatgagatggtgtggtaagtgcaatgacagtggaagaacaggggctgttacagaacataggaggaatagcaagatagaatttgggtgagtttttgaatgccctgttaggggacaggagttgaggcagggaaggggagtgctctagtcaggagaaaagagtttgttgaaacatctggaggacagagagcatgggggtttctcagaactgaaagggcaagtgtcctagaaagggttaaaatttaggctttaccagtggctgaaagattgggtctggagaaatagacttgggagtcctcagcgtggtggtagagccatgcagtagtgagctgagcaaaggccaaggattgagccttgcagaacactcgtggtctagaaattaggcatgaaggaatagaagttgaaagagaaagagggggatgtgtatgagaggcaggaagtgaagaggaatagtgcaagtggaatacaaccctgagtcctccaggaaagtagagttggctttggctcactagtctgagggttatcaaaataaacactagatttaagtttttagtacaggtttacttttagaatgtccaaataataatgtatccatttgagctagagatgtaatcatgctatgcacctgaagatgggggaaagaaaagaatatgggaaggtttgggcagcatttctgataaggagagtgggggaggtgtgggtctcagctggatgatcacagagccttttgaaaagatggcaagtctttcacctggcttgagggtcaggttattctttaacaaacctgaagtagagtagacctatatgatatacatccagtgtatcaccttcatctcattctgggacgtagcctgtgtctatacaacagcaaataaatgtttggggaaagaataaattctggcataagggtgtgggcttcagtttgtgaaccagatggcatgttctgttgttgagaggccatatgtaattgatacataaagtgacagactgaagcaaaagcaaagtaagtattttaagacaagcagttaaaaaaagaaagcagactgtgaccctaaaagcatgtgaagattctggcttctggcttttggaagagctgaaaatgtcggtgcatagacaggatgtcaaaaaagagcatgtcaaagaatagtaatggggccactggctcagattatttttaaagatgaagttgtcttctgtcaatcaggaagactcaggtttgggatgaattggcctttctgccctatttcacttctccccttcctatgctcaccccaaggttcaattcccacataaaagcagtcaggatcttgtctaggtttagataatattccccttgtaccttttagacagcaagagagaatacagacattctatgacagtgccatgtttcagtggaaatgatatgtttcaatagaactaatacagattacacccccttttaggcttcagtacttactgtgtcaggttgatgtgtgtaggagtgctcatatatgtgcgaatacatatgccttcatggagtatgacaaatggagatcatggtccagtttgtgccataatggggtaatctacctcgctttaataaagaggtggtgtcttgatgtacgcctagttttcttgagagagtcaatgagaaagttacctgaaataatctgtgtctagagaagtgaaaaaaaaaaaccagcaattatttgagggttgaagaagccatttctgttaatgggatgctgtctggaagaagaatagcctgtgcccagctttctcagatggcaaaacattttcctctttgggaagggaataagagagcacaaagaggcctaatctatacaacacaataaaacttgggtaaaaatggaatcagtgtagactgccaatttagctaactgaggccttttaaaatctgttatgcaaatcagccaaatctttcccttactttgtgctgtttagacacatgtacaattttgtgtgagctagcataatgtagtcatctggaggtgaagaaggtatcacagtttcataaactaaaatggcttctgtaacatccataaaagggaagcacacaaagacccagaggtaacctcttgcagcaggaaatgggagcttcatcctgccccctggctgccaacctcctgtcctgtttcctaccagcagatatctccattccaatctcccctgccactttggctctcttgctgtcacggtttaactgtcctgagaaagttgcactaaccgggcttgaacataaggaacctggcccagtcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgctaggcatgataaggaagagtgacttccttagattgcataatcgcttcaattctctgtttccctttgcatatgttcattattgagaataaattccaatttgagaggaggctttaattccttgtaaatgaataggaaatgagtaagtaaatgttcggtgttttcctcaaattatgtctcatattgtaagaaaacagtggcaaaaagccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaatatgccatatattttatttctttatactttttatttatttatttatttatttatttatttatttatttatttattatttttttgagacagagtttcactctttttgcccaggctggagtgcaatagtacgatctcggctcactgcaacctccgcctctgcggttcaagtgattttcctgcctcagcctcccgagtagctgagattacatgtgtctaccgccatgcctggctaattttatatttttagtagagaagaggtttcaccatgttggccaggctggtcttgaactcctgacctcaggtgatccacccacctcggtctcccaaagtgctgggattacaggtatgagccacccactgctcatggtcttatttctttgtacttttctcattacattccttgtgcccggaacatcctgcccccatgcatctctgtctattaaaattctgtttatccttcaaggcccatcttaattttacttcctctttatctgtgaagtcactgtaccttgaacagagtaggtgttcaatacatttttgtattaaatttctgaactgccactttttttattcctctgacatcaatttagcttagagatcacgtccaaatcaatgattgcttcctgtattcttcttccttccccttttctttgccaagaagaccacagattgagatggtagtgggattaaaggaggccaggggagacattgtgccccaatacaagaaaaatagaataaatggtgaaaaatcacttccatgggaataaagccaaggaagccaagagagacctggcaggaagggtagcaagggttcagctggtcctcataatccagtttgagaaaatgtgaaatcacactacccagcctgcaaacacgtgtatctatgtgaatatatccatctattcatgggaacagtgccaaagatattaaggagctacaggtacttagcagacagaaaggggccaagtacacaaatctcttcttttccttcatgttccctctctcccccacatccccccatccactttttcaaaagcacgaactttgaactacaaaacataggaacaatggagatagcagcgtagcacttaacatgactgagggaaggactgctagcagaatgagggccagtaagttggggtattacatttggaacagactttatggggtattgggatagtgggtgagagagaagtagatattggggtgagtcttagaggaaaagcagctaccagggctgaaagacttgggagtggggagaaataaaaaagcccatgattaatctagagtgaaatgatactctttttcacataacgaatgggaaacagtagcttgctcaactgaaaacatgctagaattccggctactgttgtaacaacattatattcaacagatctgcaaagtacccctaatatgtacctgaaagaatctatgtaccagtaaatgatgatatgcaatggatatcttctctttttaaaatatttatttattgagatagggtctcactctgtcacccaggctggagtgcagtggtgtgatcctggctcactgcaacctctgcctcctggggtcaagtgatcctcccacctcagcctcctgagtcactggaactataggtgcatgccaccacgcccaactaaattttgcattttttgttgagatgtggttttgttgtgctgcccaagctggtcttgaactcctgggctcaagcgatctgcccacctcagcctcccaaagtgctgggattacaggcgtgaaccaccgtgcctggctgatgtcctctcttgatacagtcaggctttgcattttgaagccctgcctctcttgtgggtgaagcctcggtgccaaagaaggaaagctgtgagatacaatgctagattttgatgaattccacactcaaaatactctttttttcctgaaggaccctactgataaatataaaatattataatcaaaaacaaaaaaagtcatggaatactgcagcaaaactgtgactgagggctggatacatgggttccagtcctagttttgcacatgctagtaatatgactgtgcaaaatactttaactccactttgaagcttggtactcccatttgtaaaatactagcatcttctactttgtgagattgttatggtttttaaatagtatatatgaaattgcctggcatagtgtctggcaatcattcaataattacagatggtccctgacttaccatagttcaacttacgatttttcaatttgacagtggtgtgaaagtaatatgcgttcagtatgcttcttgacttatgttagggttacatctggataagtccatcataagttgaaaatttcttaagttgaaaatgctctctctggaacataacttcatcataagttgagggacatgtgtaatagttttcttagtctactcatctggaaaagagataataatatctgttcttcatatgctgtgggattactatgagggcgaaatgagatattgcctatgaaatactttgaaaagttaaagatattatctaaaacataaggtttctttaatgtcaataaattcctacatccacaaagtcatgaatgtcatattttccccaatagtgagcaaatgtgcagcattattaatttgtacgtagattagtgcttggctcatggcagatgctaaatgaatctttgaaacatttgtctactgactaaccgattttcacatgacattggttctcaagctcatggttcttttttcccctcttctcggttcccctctggattcataccctctgcgatgacagcaaactctggagatgaacctcaccaacctggttaagcgcaacagcgaactagaaaatcaaatggccaaactaatacagatctgccagcaggttgaggtatgtaacagaaacatttgtgatttttcagaggacctgaaatgggtgaccctttgggaggacttcagttttgtcagagtgtagcctagtcatttggaatgaaggattgaatggcagttttagaaagtctcattcctttaggatgcttgttccaaaaaaagtgtcagaaacctatggtttaaaaagaatagacggtgatgatggacagtggggggataatagttcaaggggcaacctattctcctttccaaacagcaggcaatatgaaaatcagacatgaagtgtgcttcatccatcatcaaactggacattatcactccttaaagagattactggagtgtcatagggaagttgggaatcctgggtccttggggtaaggtgaggttaattcagcacaatattgtttctgtaacaatattatcaggactgcttctcctctttcgagcctctccccctcttcatcccctgcccatggtcctatctataccatgcaccccacctggtcctcactcattacctttccacttattcttgtcatcaacaaatcatatctattttaaagttgtaaattgtaaagtgctgtaaagtgtgaggttttaatcaattgtcatctacatcaaatcttagagcagagcttagaggaagagctgacctcttcttaaatggacataataaaataaagatgttatttctctttctcaagagcatgaaacttataccatttggttttgtgttgattttgttgaagagctgatggtagggcttcaagtgtaaacagggttgggtaaaatattataggattcttcatgggcagtggttggataaaaatgtttctaattctatttagaacctgatagtctggttctaatcttacttgtatgacagacaaatgtaacagttcaagtttattttatttcaattttattaagatctcatctcttaatccaatctatagattcctatttaagagactgtggagaatcttcttgtaaggcaaagaatcctcttattatatgagtaaccttctgacccccaatcatttggatttcttaaagtattgagtttcttcaagtagagtgtacttgtatgatgagcataccatagaaatttaatccctgctgggcactccatttgtggaagagagtggtgctctacgtagggtccatagagtactggtcaaactcagatatgagactataaaatgaagtgggggattagggaagaagcataaggaatgaaaagaaagagcactagagtgtgatttggaaaactgtgctctagacttggctcttccatgaagtggtggtatgaatctaagtcatttagcttctcagtttcagtgttcttacctataaaatgaagagttgaactgataacatgaccttcgacttctttctaggtatcacaggtcatgatgctgtgaatggtaactttctttattctattctttttctctcctggcttattctttccaagaagggagaaacaaaatataaagtatttcaaagtggctttcagctaatcagaatccctctaatgttccactctgtcaaagtttctcattatgctgttagattacagtataagacatccacactggcaaagggacaagggagtattgtaagcaggagacaagataagagatcccttgatttagaatttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttgcccaggctggtcttgaactcctgagctcaggcaatccacccgccttggcctcccaaagtgctaggattacaggcgtgagccaccgggcccggccaacttcctcttaataataacaacggtgaatccaggttacttattatcctcattcaacacagagcctgtctctccaaaagccttcaggacaaacctcaggattagaaatctagttaatggagggacttgagacttcataaatgcttaaaaatacagtagaaaatgaaatgtatagtagaatactgtcagtcatgaaagtaagacactgatgggtgatttggaattttttcattatatgtaatccagattcatctatagggaatgactatattcacagtgtataccaggcatttcacattcggcgggggcggaggataccagctaaggcgcttctgagaaaactggaatagggtattttcctgtcaaacctgttccccttctttattgtctgtaaatgtttttgtcacaaattgccttttcataaaagggccataaatactgcctccctatcatggttctttctccctgttctctattctcctcagaaagtaaacaaagctgcagtcttcctattataacagaaacagagattaagatcactacagatttgttagctgacttctatggtaatgtagcttgttataattgctgctgaaggtttcagaattcagtagatgggtggttggaaaatgttttctgctgcggctggagagcatgggaaggaggtagaggcagctccaagactccctttaatctaattaaggaagggcatgctttgaccttgctatgataaccacttgatctctatatatagttctttgtcctggctcatcaggcatcctttgtttacatttccaaaggaaacctctgtataatgcatagccaagggaaaatgtataccaacagatgaatacttcctcttcgcttccaatactccatggttctgtgaataataggcattctaaaacatagcgaggggcaaatatagttaaatacttagtaatcagttggtcaacagcatttattgagcatacgctgtgtactctgtggtgggcgatttgggggctacaaaagaaatatatgtggttgatgacctccaggaactttcagtctagttagggaaaacagtatatagtgagaaagagtatttatagagcagcatgcagtgcagaaaatacaaatgaatgtagtatagccctttcaattttacttatttagtcttgttcttagcttttagggcactgagtaaattaaaacactttcctgtatattttgtgtgccacctttttcttctttccagaactgctgtgatacaatggcttaatccatcccagaagctccatgggcaggttgatttccttctggctcttctcaatccttttaaagagctggacggcactgctctttagcattaggagaaagaagaaagaaaggagatgagttggaagagagggagaggtttcccttagtctggggaatttcagctttctgtcttgctactaggtcttagcttcattcacttttggaagtctctctctttagagttcaaacttcagatgggctggtattttcttctttctgctcgtattgcccattggaaggatatttagtttgggaagggcaagaatcttggagtctatgtaatagatgtctggctgcttctccaagcataaaatataaatattttaaaataaattaatttaaaaaacactgctatggatgatttcagcagatgatccttaaatatttttgggtggttgagctagaagaaagaatagaatttaaaccattagagcacaaatacatttgttggtggagccctctttaaggagcagtcagtgaaattagtataattggaaaatttaatggagaaaatgcattttagccaaatgttgaaggagaaaaaaaattactccctctggagagacagaaagcagaggtattagtggaggtgtaaatgagcacattttatggggaaaatggtgccttaagcactgggtgtatacagataaataggaaatggcacctgccctcaaggaacacacagactggctgagaacctgacaggtaaaatggcaaatagaatgtgaagtgataattactgtaatgaatgtaaatgcgtgatgacaagttagcatggaggaggaaacactcaggcctgcctgagaaacttaggaaaggctgcagaatggaaaaaaaatgagttatcttgaaataagagtagaattttgccaataaaaatgagataagggagtgaaggggaccacatgtgagaacacagaagggtgatcagcatggagacgttcagggaactatcagaagtttggcttggccagaatgtaagacatgagattgcaagaggtgagtatggagaagtgagtagcttgggcccaaataataaagagccttgtaggccatgtataggtgtttagactttaacctgagaagtctggggagccatggaaggattttaagcaggtgaataactgaataaaatctgtatttaagaaggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaattatagatggagaaaattgtttccatgaaaaatggaaaataagttcagtgatccagtcaatctattcatttatactactgtagtgactaattcagagtattacattcaatcttattaagaatataacgattgacatttaatatagatgaaaaacctaagttaactgtgcaatccagtgtgtggtcatagcctatttttatactagaaaagaaagtgctttataatttttcagagacctaatgcattcaatcctttttaaaaaatactttgtgacaattcttcatttatgtcagtaaagtaacatttttgaagacattaaatgttgcagttgaaatacttggagggtattaacacatgacagggtttaaggataaaattagttaggattaatattgttttcctcgccctcctccctcacatctatagggcaggtaagctttcaggtgtggtcatgtcttcatagccgaaacagttcacataggaatgcactttcatcccacttttgcacttttcctttggcacagtgaagcttatcttacagtcccgtttcccatccctcctctagttctcatttctgtgttcaaattccaggtcactcactaaatgaccagaagacttgcttaattttggctcctcttgtttgctccactattttcacaatccacccaaattccccatttccagtgtgctcttggaaagttaatggaatcttaataattcagctaaggctctatcaagcttatcctataccttgaaatgtttctagttccacttttacctctaatctctcctgccatcaacccaactaaaactaaacaaatgttttaaaaacccagacttgaaaccaaaacaactatcaccacagcagataggcacacagccattgagatgtccttactgtctctgcctgtctagaggagtccagctctgtggtacggtaagcaaggattgggaggaagagaatcttacttgaataatttgttctgggcactgtgctagagacatcatttctaatctcacttagtgtttatgacaatcctgtgatacagctggttaatattcccatttttcaagtgaggaacttgaaggccagagatattagatgccttactcaaggtcacacataagtaagctgggatgcagttctacatttctctcactccaaagtctatgttctttccattgcattgtgcagcctagtggagaagttgttggtttacttgccaccgattcatttgtgctcagataggtaggaggcagctccagaaaaccctttgtttttctccactaaatagctctagctctagaaaaacatatggtctgtttgggggcctggcgttcctgaatctgtggtaagcctcttatgtactcctgccattggcctacctttaatagcccagagcagctctccatattctgacagcccttcatggggtacagaggagagggagttgcctagagttggcagaaggaagcaataatacccacaattaggcatttacttgctcagattatttttgtgccatgaggggtggaaatagtgtgggcagctccaggtatcaacactgtcctcagccatagagtttacgctgggacccatattttcttgctgagactgccgggatgggtcctcattctagggctgtacatgaccatgtttcagggtaaaagtagtctccatgagacacagggtttcttaacagttactaagagtttgacagtaaagatgtactctcaaaagtataattaatgtttgcacatttaaaacaggatataaataacaaatataataccacaatgactgcaaatatatagatttcctcaaaaaagagtgaatgcattgctattattaatggtgtcttttgatggaatgattacttagaagtacacatacagccaggaaatcagctatttactacctcaagacagaaagagaatccaatgcctctgtctattctcactacctctcctctcacctaaatcaaatcttgaatccaagtttaccctatctcagccagtcctaagaactcttaattattcctaagagctttaaatacattagctcatttaatccacacaataacccaatgaagtacatatgattctcattctcattttacagatggggtaactgaagcacacaggggtaacttatttgtataaaatcacaggtggcaaattaagagtttgcatccaattttactgaggtccttgctcttaatgactatgctgtattaaaaaagatgggcaaaactaacaacccatggctccatgtgcagtgttttgcaagtcgctgattattgtgcttatggtctgggtaaggacagaaaaccagaaaaccagtattatgtgagcgtgtgcccatgtgggaatgatgtggtgtgatactagagcaatatttgggcaagcctttctttgtgatgataatctctccagagcatgcatcataatgcctctgcacgtgctatgcatctgtctatctatttcatagatggctgtgcctggctgttcatctcttatgtgtgtctggggagggggttgtatgtgtaaagaggatatatgtggaaaaaaggatatatgcccagtgagagaattagtgtttaaactgggtcatgaggattgctttgacctgtttccctccccgcccaccccaaagggttcttttcagtcctttgatgttttccccatataaggggagaaactgggacacaactggaggatgttgccttttgttttctttaatgagaaacattgactctttccttgagagaaggttttcctcctcttctccatatcccaagcctgttccagcttctccttagtaacatcaaaggcacaaaacaatcactggctttggaataatttctaaaccaataaaactctagctaaaagtgtatagcaccagtgctagtcgcatagaacaacatagttccatcctgagctccctcatcccaatctatatatgggtagttttgcactggcatagaatggcaggtttacgaatgtccaaagatgtcttattagaaaaatctcaggtacaggggaaagcccaggacacgaggaggattagagaagagggtgagtgacctaggcagggaaggataacaatgctatgtgaaaaggaaggagaaacaattacacgatgccagtttactctatagtgcacatataatgaaactcctgccaaatttgtggtgtgttctagcatctgaagagctttgaatcttctagcaccctggggatattctgggattccaattgccacccactcaacagtcaagaaattcaaaccatttcaggaggattccattggctttagaatgaaatggaatttatattatattggtagctcacagagaacacttacatttaagaagtaaaaatatatcacagatgaatacgcaaattgcatattgtctgcaggccagagagcaaaattaaacaccttcatgctttcgtactccatttctgtcaaaaacaggatatcagcagcaaagccactgaaaacacacacacacacacacacacacacacacacacacacacacacacacacacacaacactgacctacagtgagtactgccaaaccccatgctaacccagtgacacatcattagctcagaagttgaaagcaaatggtgttcctaagtggacctttataaaaaatattaagctccactgtgggtttagcatagtgttatgtgatacagaggaatatagtagcaggtgtattaagtctctatccctgtcttcaaggactttatagtctagttgagaaagcagagctaacagtatgaagcattgccaagcaatataaaataatttaaactgtgtgacaataactgtaagtgctgtagtagttcgggggagagggagatggaagaaggctaacatcattaccatcattaacatctattgtttattaacacttaatgtgctccaggtgtcatgccaagtgctttacatgtattatctcatttaatcttctcagttacctctgagacaggcactattattatccccatttttcagatgaggaaactcagatagctaaatgatttatccaaggggagtgtagaaatgagactagagaggcatggagggacctgattacagaggacattaaaagccatgctaagaagtttggcatttattctaaggtcaaagggaagccaattgaaatttagtatgaagccattttaagcacgggtgtagtgttttttgttttttgtttttgttttgttttgttttgagacggagtctccctttgtctccaggctggagttcagtggtgagatctcggctcactgcaacctccacctcccaggttcaagagattctcctgcctcagcctcccaagtagctgggattacaggcatgtgccgccacgcccagctaatttttttttttttttttgtatttttagtagagacggggtttcaccttgttggccaggatggtctcgatctcctgaccttgtgatccgcccacctcggcctcccaaagtgctggagttacaggcatgagccaccgcgcccggcctgtagtgtgttttttaaaaagtttatactgcccctctgctgggttaagtacacattgggaaaataaatgattggagacagaggggccaattaggagactgtagtagcattgtgcttggcacatagtaggcactcaatgtatatttgttggatggatatatgaattcagggaagagattttggtggacagatctagtgaaatataagggaagatgatagaaaaggatagatttgaattatatttatgaggtaaatataggggatgtgatgattaactggatgtggggaataagaaagagaagttaagaatgaagccctgggtttctgaggagctggtgatacccttcattcatttagggaacattagagaagaatcagatttaatggaacaggatgtaggaaagagacgagttcagtttggaaacactgagtttgtagtgcctgtagttatgcaaatgaaatgtccagtaagcagttagttatataggtctaaatttcaggagagagacttaggatagacataaatataattaaggcaaatggagatctttttgaggtgatggaattgttctaaaattggattgtggtaatggttacaaaattctgtaaatttactaaaattattgagttacccacttaaaatgggtgaattttgtggcatatacattatatatcaataaagctcttaaaattaaaaaagttaagcaaggtactggcatgtagagagtaactgaagccttagaaatggatgaggtcacctaagtcagtgtgctagaactctcagaatgctgacatttaagggacagacaaaggagttggaatgatcagcaggaaaactaggaaaatttgtctcatggaagctgaaagaagaaagtattttcagaagaagtgaatagatgatcttttaaataatgatttgaaagacttaaatatcttgaaatgtcaatgggaaggagtggaaccagaagagaggttggctgaaggaaagggaagaagattaatcaaatgaggaccccaagaagctagaagaggatggaatgcaaagcctctaggagaggactgatgaactttctagagagatatatcacttctttgtaataggagaaaggaaagatgattgtttccttattgttttgtgagaatttaaaataattccctgggataaattttattttctctgtgacaaaggaagtaaaatcatttactacgattttactatgagtgagaagggaggtagtagggttgaagctttgtggatggtagagatcgctgctgtggagatatagagagagctgttaagagaaacacagaattaataagaaactttgagagcctgcttgaagttggacaccacaaatttaagggggatcaatctatgcttccatgattagcatataggtcacacttaaaaccatgaaaatgaatgaatttggccaggaaaagttgattaggtgaggaaaaggacatagatatagattagatagagataatatatattattaactttttacctgtcacgtgttgtgatattttccccccagtttgtcttttgtctttattttctgtatggcttctggtttttctggcttgtgaaaggtctccccctcctcaaactttcttttcatattttcggtggttttattttttatattttaagtctttaatgtacctggaatttgttttagaatatgagattttgaaatgtattttagggcatgtagttgtgtttcctttcagatagataactattatgctaagcccatttattaaaagaacagtccttttcctgttgagtggatatgctaccattgccatatattggatttccatatgtacttgcttctattctagactctattctgttccattgatttaattttccattcttacgccaataccttactattttgattatactgactttttggtaatatctgatatttccttactattcttagatatttgtttctccatatttttacatatttgtgtctccatatgaacttttaaataattttgtatagttacaaaatatactcagtttggattgtgattatcactatattacagttgtgtattagtttttagaagaaagacattcctatgatatgtcttcctatccagaatcacggtatatctttgcattttttcaggttttatttttgggaccgtctctttaatatttagttgttttcttcaaataggtacagtacatttttttgttgttgttgattcctaagtactttgtactcttgtccgtgctgtgaatgggttacttttctatttccatttttaaaagcatatggagaaaagcttttgattttatatattttcttgtgtattacaatcttaccatattggcaaccttatatttaaaaaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctccttctatttactttcatttttttgtccttttccagtttcttaaattgagtgaattcctgtattttccatttttatatattttcctgagtagaggtttaactgtatcccgtatattttggtatttagtgtgtgctctttcattattttctataaaattaacaactttagtttcattttcctctttgattacaaggttatttaggagtattcaagcagaaaatttccctgacccctttgctggcaggaactggagtgcacgggtgctagaactagtcagccacttcagtgccagcaggggcagactccacttgcttggccccaccgtgttccacgccttgcaggagggggagcgcaggtgagcaggtgaaggagctggggcaagcgcttttgggtgctggcaggagcgaaactgtgcttccccacagcagcatctaggggggtgtccatatctcctgaagctccagaaagagtgttacagtcagtgctcttttagctttgctgtccatgaatggcttaagtgttaacagctcagtggagggtcagtgtgacggccttttgcacttgcacttgagttcttgttcaacatccaagaggaatgaggtcgcatgaacaaattggagatggtcaatgtgggggattttattgccaatgaaagtggctctcagcaggaaggggagctggaaaggggacagagcaggatgatcattttcccccagagtctagctgtccccagctggactcctcttcgaagcaacaccgtaaagccgtccctctgaagtcaagctgcttctttccaacttccaaccatagtccccaatgtccagctgcttctcctcttctctctgctggtgaaccctggggtttttatgggcacaggatggggagcagggtggggtatgggtggttttggaaaaggcagctttcaagcgggaaaataggaatgcgtgttctcactttgggacacggttccaggcttgagggcaagacctttgccagagacctatcctcttctgcccagaatttccctgcctcctgcccctgtcatttccctcctctgaagaggctcatctaactgctggtgtaatatggacgatgactggtcttagctacttcctgtttacagggggtgtgagtatgggaagaacagcagtcagattcctccccaaggtctacctaagggtccccagcaaaagggagccattgtctgaggttctggttgcctgactgtttggagtttgatggcctctaggtgcaaagaaacaagttttacagggttaagtatgcatggaccaaatatatgtccaaagaggagttaaaaggagagaatctaatgctgaagattacagaaataagaagtgaaatatactaatcattctgaaatcaacattataccccatggtatagcacagaatggaggtaaaaacaacaagcctaggcaagactataaagaggatatccatggaaggttaattattaacacttatcttttgtgatttttagcttgagttccccaatctcttcacataggtactttgggtgctcttctgggttgatgcaggtaactctgtcagcttcccaggcctttactcgggtatagtgaatacaatgatctattccagtgactttcagtgccataagagtagaaagaagtataatccctcccaatctgggcttatagagggagaaagggaagcaagtacctttaccagtattaggtccactgggttgaatagaggtggccctagttcctgggattggacctccaacagttgtttcagttcctgttggaaatgggccaaagaagttatatgtttaatcaaatcagaggatttttggtctagcaagaaatcattcgtgagaaaaggccatccatacatcatttcaaaggaactcaaacccagctttggaggggtgtttctaacatgtagtagggctatggggagaagggtagttcaggggcgacgagtctcctaagacagcttcctgaggtgcattttgataatattcatcttttctacctttcctgaggattgtggtctccaagcacaatgaagatggtactgtatgcctagtgcctttgagaccccctgggtgacggctgccttgaacaggggccattatcactctggaggtacttagggagtccaaagcaaggaattatctcattaattagtacttttatcacctcagagactttctccgtctgacaaggaattgcttctacttagttagtgaaggtatctatccacactaggagatactggatgcctcttgcctttggcatatgggtgaaatccactgctagtcttcccctggatagcctcctgtcctttggattcctgggggaagaagctgtcgattaaggggattattttaaaggcaggtctagcaagcattaacgatctgtttaactgtatcaggtttttacctgagagcaatttctgggccaactgatgggttttatccttacgtaggtggaaagcttggtgaaggattttaagaactttccattggtcagcagcctgtagatgaagcttgctgtcctccaattgtagccatcctggggactgaaagatgtatccctgagagattgcccattctatttccacaggagaatatttagattatatttctcttaaggggccctctcagatcagtgaggcttcaagtggatcagaaatctgaggctttgttgctgctgatttagctgcttggtctgccaatctattttgcttggctacttcatccatacctttttggtggcctttacaatgtattactgccacttcacatgtgagaaaaaccgaggataatagtctattaatttcctgatggtatttaatgggactcccattacctgtgaggaagtttctcgctttccagatagtggcatgggcacagaggactaggaaagcatacttagaatcagtgcaaatgttaactgtttttcctttgcttaatttgagtgcccttgtgagggcaattagtttggctaattaagcacttgtccctgagtagagagacacactctcaacaatatcattcagagtaactattgcataccttgccttatgtatcccttgttctacaaaagaacttctgtctgtaaagagaatccagtttgggttctctaagagggtttccttgagatcctctctggtcacataggtctgtactactagctgttcacagtcatgttcaagcttcccagcttcctctgggaggaaggtggctggatttagggagggacaggttcttaattggacttcagatccctctaatagcagaacttgatacacgaggaggcagttgtctgttagccagagattccccttagaagacagcagtcctgacacattatgtggagtgcaaacagttaagttattccccatggttaacttagtagcctttggtaccagcaaggctactgctgcatctgcctggaggcaggctgtccatcttttggctaccaaatcaagctccttacttaggtagcctacaggctgctgggctggaccagggcttgtgttagcactcccagggccatttgctttgcttctgacacataaagattaaacatcttccctatggggagactaagggctggtgccttaagcaaggtttgctttagttggtcagaggcttttctagtcccaggttcccaaattagagagtgagttttagctgcctgagtatcctttattaggtgatataagggacaaactatttcaccatacccaagtatccatagtctgaagaatcctgtaatacctaagaatcccctcagttgcttgagggttttggggaggggaaaggaggagatggacttaatcctttctttgcccagtgctctggtcccctctgacaagatcagaccaaggtacttcactgaagtctgacagagctgagctttagattttgaaaccttatatcctctattagccagaaaattgagaagagccttactaccctccgagaggtttcctcagttcgagcacagaggagaatgtcatctatatattgtaaaactttaacctgaggataaaggaactcagagaagtctcttgacaatgcctgcccaaacaagtgagggctgtctcagaatccctgaggtaacactgtccaggttaactgggtagtttggttagagggatcctcaaatgcaaacaaatactgggagtcagagtgtaatggtatgcagaagaaggcatcctttaggtccaggactgtgaactgtttagttccttcaggtacttgagatagcagggtatacagattggaaaccactgggtgtaatggaaccacagcttcattaacaaggtggaggtcctgaactagtcttcattccccattgggtttttgtactcccaatatcggagtattacaagggctgttgcagggtttgaggaggccctgcaaccttgttatcaatgatggcttctagtcctttcctaacttctggtttcaggggatattgtttctgattaggaaatgaggtgggatccttaaggtgaacctggactggtatggcatttgtggattggccaattttcccttgaattgcccaaacttctgtgttaatatcagtcttcactagggggagacaaatagtttgttcagaggccaccagaatggtggtccccatactggccagaatataccggttcagcagaggagttgggctctcaggtataattagaaaggcatgggtgaacaacaagtctccccagctacaactaaagagttggaaaaaataccggattaagagcctttctgagatacccctctcatttgtgctaagagaagagaaggggcccggattggagaggagagctgagagaccaaccccagtgtccaaaaggaggtccactttcctccctttgattttcagaactacctggggctcctggatggtaatggtggtctggaccactggagctacagagaggagccctgggacccatcagtcctgctgaaccatttgggagattggctctggacctggtgaccagcctccctggggacagtctgccttccagtggtccccactacagattggacagggtcaaggtggcttcctcatgctgccttggcaatcctttctaaaatgtcctggcatactatatctgtagcagttaacaggtgcacctcaggaatcctggggtttgtgggctttcatggtggccattaaaccctctgcttctttcctatgttttctctctctctcctggacctccctatctctattataaaagatcaaggtggccactttcaggagattcactaaagtactatctggtcccagggtctgtttctgcagtttcctcctaatatcaggggctacctgagtaataaatttatcctttaggattagttgtcccttgactgaattgggagatagagaggtgtgctttaccaaggcccctcttagcctctccagaaaggcagtaggattctcatcaaatccctggtctgtcacgggtagcttcgtataactgagaggcttagttctggtcctacgtaagccctccatcatggacacctaaagtgtctcctcttccactctcccatctcaatattgggatcctatttagggtcatccaatggtactgcttcccttccaattggataaagtttgactccttccctgacaatatatgtgatactaagctcatccccaaatccctctgtcagctgcagaatggcgtgcttctcagtgttagggtttgattcaaaagtaacataatgtctttccaggagagttcagatacttgggttatattctggaaagcctctatacaactgtcagggtcatctgaaaacttgccgtgatcccccttaatctgccttaagtcctgtagagagaagggcacctggaccttactggggtcaaattcaccaggcatctgttggagaggcaggagtgagactggggcttgtccagggtgaagatttctaggagggggcaagtgagagagagaagctggatggggaggaaggggtggacccagaggagcagcgctggagggagctggctgtcctgctggaggtgtctctggggttcatttctttagttccttgggattgccacttgcagccttccctgagatggcaaaccggagggctgaaccaatcctacactatcagcaaaggtctggattacttgcaaggaaaagaaagtctgcatgtatggcctcagaccatctgtcctcatgtttacagaaaaggtccaactacacgatggtattgaaatgaatggttccttcctgaggccaagacagtccttcctgcagatcacaatttggctaaacctttgtgctatgaggcattttacctccagagtatgagggtcaaagcagttccagtgattcaggataccctccagaggagtacagactggggtggtgaagatagctggttacccattccgaaagacagggaaataggtgtctctcatttcacttccttctttcagtgaaaacttgaggtatgagggagagagaaagtgaacctcctccttttctcttccatcattttatccccaagacttggcaaccttagatggatgccacccacaggtgccattgcagcctgcactcataaaacaaggagggcctagagaataggaattgtctgcactcacctatgccttcatcccctttactgccggcaacctttgggttcccagggctttatctatgccgtggagcatggcctccttccatgaagcagaggcttaatcagcaggaatttgtcctacccatttatactgtgcctgttgcctcacttgggattcttcagatctggttttcctttctagggcttcaacccaaagtttaaaattgagtttagggcaaaaaggtgcatcagtgggtgcatggattcatttagattaagtccatgatgggtcctgtcaaacttgcagttatcagccagcggggccactcctccattgctgccctatcataaccagagtgccgaggtaggaaaagaaccctatcacatagaaaaagaaaggaaaaaaaaaaaacagctgaagagagggggaagaaccccttgctctatgcaaatgggttcctttaatcactgtattcttcccccgctttggactgagctgaactcctcagccagaggagtaaaggctctatgggcgtgtgatgggaggggacggtgagtgggaaatgctggacagctgcccgtgtggggtccctgggccccaagactgccctggggccctggctgcagctgtgattttctcctgccctccatggctgttggaagtggcacatgcatgctttggacatgcccaagtgccccagccaggaggggaggggatggagaggaaactcactgcgtgccatgcatgtctgcagctgttggggtgggggtggggatggcacctctaagaacaaacggaaatcacattgttctgaattgcatatctgattgctgggccaaatgttcattctacttaataacatttctgcagtttgcagcaaaactcttaacattataaaagaagcaataggagccatttcaaaccatagaagaagaaaggaaagataccacagaaaaatctgagcatcttggcggaccacctattacattggggatggggtccagttcaggggccttctggcaacaacgaggagtggcattggccagatgccttcagctgccccaggactttattctggtcccacatgatggctagacccatgtgaagggaagcagagccttttacccaaaagagaaatggcagggttgcatcctgccccctgcaagtggcatagatcagaggaaagtctgaggacaagaaaagacagatccacatttttgcatttactcacccttctgacgtatcccagacaaggccctaaaatggagcaggaaatttccctgacccctttgcaggcaggaactcgagtgcaggggtgctagaactagctggctgcttcagtgctggcagggatggactccacttgcttggtcccactgccttccacccatcacaggacggggagtgcaggtgagcaggtgcaggaaccagggcgagtgcttttgggtgctggcaggagcaaaacttcatgtggatctgcagcagcatctggcgggggtggggccatgacccctgaagccccagaaagagtgttacaatcagtgctctttcagctttgccatccacatatggcttaagtgttaacagctcagtggagggtcacggtgactgccttttgcacccacacccgagttcttgtccagtgtccaggaggaatgaggtcacatgaacaaattggagatggtaaacttgggggattttattgccaatgaaagtggctctcagcgggaaggggagctgaaaaggggacggagcaggaagatagtcttcccctgtagtccagccatccccgaccagactcctctccaaagcaatgctgtcaagctgtccttctgaagtcaagctgactctctccaacattcaaccatagtctctgatgtccagctgcttctcctcttctcttctctctgctggcggagcctaggttttttatgggcacagggtggtgggcagggtgggccatgggtggttttggaaaaggcagcattcaagagggaaaacaggaatggatgttctcactttgggccacagttccaggcttgagggtgggacgcttgccggggacccactctcttctgcccagaatttccctgcctcctatccctatcagtatgtttcttaattttcaagtggttaaggatttgggaatttatctttttgttattttattcttattttacaggatagtgatcagagatggtaaactataaactttttcttcatgatcaattttaaatgctccatgaatataagggaagaatgtattattctgtatgatgcaaagtttacatgtaactattatattgatgtattgatggtttttttctatagtcttatttttgtttaaaacttgttttgttagtttcacactaaaactataactgtccagtgggttcctcttgtctgctgcccagatagagctgacttatcaagcagaagaattggcaatacagagaatttaattgacatgaggtgggccatgcctctcagaatttggggactagggtttttctttctttttcttttttcttttctttttttgagacagggtctggctctgtcacccaggctggagtgcagtgacatgatctcaactcactgcaaccttgacctccctgcaacctcagactcccgagtagctgggactacagacacatgctgccatgcctggctaatttttaaatattttgtagagacaggatttcaccatgttgccaaggctggtctcgaattcctaggctcaagcgatctgcccacttcagcctcccaaagtgctgagattactagaatgagtcactgtgcctagcttagggttttccaaaggtagtttgggggaaggggtgggagtggttagtcattgccattgggaagtggttctcttgcatgctgagtcgcttctgggtcggagcacatgagtgattggcaggtacaggtggagccattcatggtcagatctacaaaaaaacctgaaaaggtatctcaaaaggccaatcttaggttctacaatagtgatgttatctgcaggagtaactggggaaattgcatattttgtgaactctggaataatggcaggtaatcatttatgtctacatcttagcagaattcaggcttttctatgctttgagcctggtggtctctcattagctttacaaagatggtcgagttttggggaagggttcttatcatttaaactataaactaagcgtctcctaaaattagcttggcctaagcccaggaataattaagggcagcttgaaggccaaaggctagatccaatttccatcactgacatcgttttctcactgttataagttttgcaaaggcgatttcaaaattgtatcttttttctatcttatccctttctatttttaaggatatttatttcctagaagtggaattgacagtttaaagtaaagccacgtttcaatgtattgacacatattgtcaacagtctctatttgccaaggcaatttatactcccaccagaaatgtacaagggggcagattttcctttaccatgctgttagagtgctactaaattcagtcacctacacttagcctttttggtcatctctcagagaaagattgttggatgctgggcagtagtagagagcaggagctcccactgggttagggttaggtctgacaaaattggtgaaggtcatccagtgggcatagtacccctgttacaaataagactgttgaacttttgaggtttgggttgcttcaatacagaaagaggtcacagaaatcagaagcagttttgattaagcagttaaatgtccccatgttcgacttaagtagttccctccacactttctgccatccctgcatcctctagatttctcactctctttgttctgcccagtgatgaccttttcttctctctggtgtgtccttcaaaacttgttttctgagatactgaaattcacaatgacatatgaatgaacagaaaccactgtacagggatctgccttttcataaaggacatacgttcctgaaagtagaattttaagcatggatggggtgtatagtaccaatgaggtcttctatttcttcactaggaaacagcactcattaattattcattagaaatatacatggtatttgaaaaaccagtattaaattcctcttcataaaatacctgattcaaacaaatcaactgtaaaagtacacttttttatgtaatcaggacaatttaagtatagaacaagcattagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagaggtaccagaccagcgtagcaacttggagttggagaggagtaggcatggaaatcaatatttatttaattcctactatgttccaggtagtgtgctaagacctttgtctctgttatctcatttgattctcataaccacttgtgaggtaggtaacattgtttctattttaccagtcagaaagatagctcagagatgttaagtgacttgtcatgaagtcacttggctttcaagcgtcaaagcaggaatgcagattcaggccagcctggcttacaatccagactttttcccactctactctgctgcctgagtagaaatggaaacttagcacaggaaaatcctcaaaaaaagggaaaggtggttttcctcaaaaataaaaataaaaataaattttagctacaaagagaccaaaaacaaaacaaaacaaaacaaaaacagggcagattagaatggaacatggcagaagtcttggccttggagttaggatgcccagtttggttgtaactctgtcatttgctagcttatatgactttgataatttactttacctctctagatctcagtttcctcatccataaaatgcagacagtagtgtctaccctatctaatcaggttgttgtgaagatcaaatatagagatcaaatatatctgaaagcactttctaggccaagccataacaactacacagctgtaataactatacaaccataactaattatttcttttactagcagtaacaatgtattaagatggccagatttttggaatttcccagcaggttgagatcccttcccgtttttgtttttgttttttttccaggagaatctcttatttatttatttatttatttatttattttattatacttttaagttttagggtacatgtgcacaacgtgcaggtttgttacatatgtatacatgtgctgtgttggtgtgctgcacccattaactcgtcatttacattaggtatatctcctaatgctatccctctcccctccccccaccccacaacaggccccggtgtgtgatgtttcccttcctgtgtccatgtgttctcactgttcagttcccacctatgagtgagaacatgcggtgtttggttttttgtctttgcgatagtttgctgagaatgatggtttccagcttcatccatgtccctaaaaaggacatgaactcatcattttttatggctacatagtattccgtggtgtatatgtgccacatttttttgatccagtctattattgttggacatttgggttagttccaagtctttgctattgtgaatagtgccacaataaacatacgtgtgctcgtgtctttatagcagcatgttttgtaatcctttgggtatatacccagtaatgggatggctgggacaaatggtatttctagttctagatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcccagctgctttgtttacctactcaagcctcggcaatggtgggtgcccctcccccagccttgctgccaccttgcagtttgatctcagagtgctgtgctagcaattagcgaggctctgtgggattaggtccctctgagccaggcgcaggatataatctggtgtgccgtttgctaagaccattggaaaagcacagtgttagggtgggagtgacccagttttccaggtgctgtctctcacccgtttctttgactaggaaagggaattccctgaccccttgagcttcctgggtgaggcgatgcctcaccctgcttcggctcacgctcggtgcgctgcacccactgtcctgcaccctctttctgagactccccagtgagatgaacccagtacctcagttggaaatgcagaaatcacccgtcttctgcgtcacacacgctgggagctgtagactggagctgttcctattcggccatcttggctccatcctcctgtttgttttatacctttttttttttttttttttgagaaagagtctcaccttgtcacccaggctggaatgcagtggcgcaatctcagctcattgcaacctccgcctctcaggttcaagtgattctcctgcctcagactcccgagtagctgagattacaggcatgcgccaccatgcctggctattttttgtatttttaataaagatagggtttcaccatgttggtcaggctgagcctaaaacagacctcaagtgatctgcccgccttagcctcccaaagtgctgggattacaggtgtgaaccactgcgcccagcccatcctaatcagggcctctgacccccttggggttttccccgtagaaacccctttgtttatttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctatcctttttttttttatacccagcacatggcttggtacacgaataggtaccgagaaaggatatttggataaacattgccatctggtggccagatgttgtaagtacaatcttttatgcatcataagggtgagtaaagcccaggtgagtaaagcacctaggaaaggcaactttttatttattttaacacagggaaaggaaatatttcagaatatgtggtctcctagaatctcctaggtctcctagaggtgttgttattccaacgtctctccaaatctttcataattcagaaaacaatatttaaatgacacaacagataaaactattttgagtgtgcaaaaataaaatgaaagagaaatttgtctcatgtaataaagaaatgtaacatagtatacaataccttttttcataatacctttatttcaatgcctacacacattcattcattcaacaaatatttactgagcatttactgtgtgacaagcactattctaggtgttagggatacagtgaacaaaaagtgcttaaacttaaggagcttacattctaatgggaggagacacacaataaacaaacatatttttattagggattataagtattacggataaaaataaactaggttacagagtggggtgagtgtgtgtgtgtgtgtgtgtgtgtgtgtgtgtgtgtgaaagagagagagagagagagaacgccagttgagcaaaggcctgaagatatattagaacttcagaaaactacagaaatgttggttgaccaggcctgcctaaaacattatgggacttctagagagttttctttcttttttctttttaaaaataagtttaatcttacataaaagttgctaaaataatacagagagttcccacatacatttaactaaccttctctaatgttaacatcttacataaccacacaactatcagaactaggaaactgtcattggtacaataattctattgagcaaactatagacctcatttgatttttaccagcttttgcatgcactcaactttttttggggggggggtggatagttctattaatcttatcacatttatagattcttgtaatcaccactgtaattaggacattattgttttatcatccccccaaaactcatttgtgctacttctttataggcacatctgtcccccagcaaccactgatatgttcatcattactataattttctcatttctagaatgttatgtaaatggaatcatatagtatgtaaaatactgtgatttgctatgtcactcatcataatggccctgagagccactgaatttgttgtgtacatcaatagttttttattttttattactaagtagtattctactatgtgaatattctacaatttgtttatatgtgcccacggtgaagagcatttcagttgtttccagttttttgctaatagaaacaaagctgttatgaccattcgtgtaaggtttttgtgtggacataaatgttcatatttctagggtaaatacacaaggatgagagctagagagttttatttcttcagagggatttataagcaagtgccatgctttacaaaacaagcagtagattggaaagaacactggataggactcagaagatctggctcaagccttgccctgtcatttagtagcaatgtgatgctggataagcctctcccctctctaggccccatatttctgtctcttaagtgatggagtaggaatcgattatttcttcagtctttttaagatctaattacatggttctgacgagatagaaaggaggtttctgcctcatttcacaaaaaattttatagctatgtacataaaataccagatgaaaaacataggttatatctcccacctttttcttccatgttccaaacagttacttggtggcttacacctgtaatcctagcactttaggaggccgaaggtggatggatcgcttgaggtcaggtgttcgagaccagcctggccaacatgatgaaacccatctctactaaaaatacaaaaattagccgggaatggtggcgcatgcctatagtcccagctactcggcggggttgggggggtttgggggctgaggctggagaatcacttgaacttgggaggtggaggttgaattgagccgagatcatgccactgcactccagcctggacaacagagcaagactccgtctaaaaaaataaaaaataaacagttactttgcttacaaagagaatatgggggagacagtaactaagcctaaggctataaaggtttggttgtctgttccctgaggagaaaggactccaaaatcaacacagaatggccacatggcataatgccattcctaaggcatgtatatgaagcagattgtcctcacgctctgtctccattatttttattagttagacatagagtaaagtacatacaaaatatatgtgtgtatatatatgtgtgtgaactgtctatgcttttaaaatatgttgtattatgcatttctatacaggtactattttttttcaaaagtcaggaaggaaatacacaaaatatttgcaatggttaactctagagattgtgattgtcgtgagaggcaactctaaaggaaaaagaagtatatgtttgtgagcacagcctctctctctctcacacacacacacacacacgcacgcatacacacagtggttaaaaccatagacatgagccagactgcctgggtgcaaatcctggctctgatatttactagttatatgaccttgggcaagttacataacctctatgttttctcggtttcttctatagaatgggaatggtaataatagtacctaccttatggggttaatgggaaaagtaaacaagtgaaaatacatgaagcaattagaatagtgcctaacatgtggttagcactataaaagtattaactcttatgtactcctcccacaagcagatagaaaacttttctgtcagtcattgtctatctgaaggcctcacgtagcatgagtccctgagcccaattcactacgatagttatacttctagaaatggcttggctgccacctccccatccacactacttttctaactttaacagccaatctcccagctacctctactctcctaatccctcaccccttccctggccaaaaaaattacacactgaagctgtagattccttaactatgtctcagtattttttttgcttgctaaactgtagttactccagtacaggtgactaaaaattctattaataatttcatttatttcttgctcctttaagtgaccaccctccctcaaatctaaagaaacaggtataaccaattttttttaaatccctgcttcatttagtcatacttacgtaaagctggaaggaccatctttgaaatgttgcagtgtttacctttagaaaacaaaaaagaagattgtctcttcttcctcttccttttgtacatttgaaacttcctgatataacagggctatagtgctggtggtgatcatgatgctagtgctagtggtagtgatgtgtgtgtatgtgtgtgcgtgtgagagagtgtgagggtgggaggagagagggagaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatctttgcaacttatggctttggcgaactcccacctatttatttcctagtattgaacagtggtaaagtccttccatcaggggccttatgtgtttgtattaagaataggtggaaattggggaagactaggtcttactctacagtcagtctttgggctgggaggtaatagggtaggatgggcagttggaaagaaatatgcaagtcaaatttttgctgccttaagaagaaagtaaaagagcaaagagcagagaagaggacctggagacttaccagggagcctgtgttgcctagtgtttaggacttggaagattgaggctaagactcttagtcataaacatcacaaactgcctcccaaaagtctttttggggtgggtggatttatacaagtaggttgccaagattgacctaatggtattttcaaggaggatagattttttttccacagacataaagccatttagacaaaaccactaacctaatacaaagagcgaatgtcaaataaagagctagggtcttccacaaaccaaccaaccagccaagtatgcttattaaggtaacccagttattttcaattaagcgttaataagcaagtgaaatacctcaatgtattatgtcttcaaacaaagaaaataccaggggctttcaaatgtcttccaagcaatttgagttgttttattcacatcacaaagaccggttttccctgaagtatttcctgttcagaaaacacttaaggaccctgctcttctggggtgcttcttgacatgaaaagattttaatgtcattgctttacctttagtttggaattgtgcctcttcagccaacttttcattctattagttgtgcctggttttatctcccctgatgtgactgtccaaaaaacattcccaccctagctccctcatttcaccttatattttctctacaaaatacactcactggagtatattttataatgcttggcattcttattttgatttttttactgtgctaaatcagtcagtaaatgtttgttgtaaggctttgtaccagttataatgggagagacaaagtagtgtaaaatcttccctcaaggagcttgctgtctaattgaagatatgtaagcaaaagagtgcttcttatatttgatatttcctttctattactgatattctccttgggtatgccctgtccacatcacaacagcctcctaaatagtcctcaggtttactattaccctccatcaaatcagtccctgttcatcttcttaaacaagttcactgtggtacttctcgcaccaccttacctttcctcccctcaaaaatactacttaaagataccatattgcctaaaaataaagttcagtctcatttgtttggcttgaaatttctctccttcacacctttttaatctaagtcttattccatctttaagatttaattcaacttccatttcatccatgcatctttccttcacttacccaccaaaagtaatctttccttttaatttcagtagattatagtctacatcacccattcagtatttaatttatgctaccttgattggtttcttttatatgtatatggctcttccccatccagtttgcaaagtttttgagggcagggccttagcataatgctttgcacagaaaagatgcttgataagatgtctggtaatgaagacatgatttttcctggcttcagagtagaggaaggattatgaggatgggtggcaaaggaaatattctggaggtagggagattaattaacgaggtttttgcaacaacagtcctatcacaataggtgataagggcttcaacctattggttccttggctcagatcctcactatattaacgaataagggtagtcaagtgaagcagtgggaatggagaaggaacaaagaaacctgtaactatttgcgatcagttggttgtaaacactactgcacttggaccagccactgaggaaatttagcatgattaaaaaggaaaggagggaaggactttgggactgctgtgaatttatgtggggacaaaggagaagtagcagtcagagtttactgaacctgagtaactgcaataatgatagtagcattgacacaaaaataggaaaatcagaggtggaagccagatctggagagaaggtgataagtttgtttttagacttactgagtttagggtaacttgagtaacaaagtggacatgtctaatgaggagtaaaagataccttttttcacatttaattcaatccaacaaataattacggagcatctactatgtgcccatcatgatagtggagctagatatagtcacataagacacaattcttgccctccagaactcatgatggagtgaggaagacagactaatatgataaaatataggaaatggtataattgaactatatatagagtatgtgaaaatataaataggggatcaattgcttgtgtccaagcaagtgagaaaaatcatagaagtgatgatctttgagaagggccttaaaagataagtagaaatgtgttcagtaaacagatggggaaatgactttccaagtaaaatgacaatctcgggcaaaggcacaggacatgaaagtgcatggcattctaggggaacaacaaggagtctgaagtgactaatgagaaacggatgacagaataaagatggatgatttgaaagagatgatgattttcagaaattgaagaaaagggtgttgttacactcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtggtgcttcaatgcccttgcatcattaatatcatcatctctacccttcttctaggagtggatcttatgagggaggtatggaagaagttgtgcatgcttagctgtcagtccgaaccttttagagccagcaggggacaaaggcaacaatcactgtgtaatactctgaaatttcttggcaggtgaatactgctatgcatgaggcaaaacttatggaagaatgtgacgagttggtagagatcatccagcagaggaagcaaatgatcgctgtcaaaatcaaagagacaaaggtaaagcgcagcacttcagtgaatccaaggaagggttgactttacaaatatcaaagtttgatccagatgattctggtttgatcatgaaatcaagaagaaatgagattatagggggagaggcaaagaagtgatgtttggcctactgctctgaatccagtaaaaacgatggccattctggggtgttagaaacgttctatatcttgacctggtttacgtgggtgtatgtgtaggcaaaagttcattgagctgtacacttaggatttgggtgctttactgttgtatgttataactcaatgaaaaggaaaaaagtaatggtagaaatgtgagtcaggattatggaccatgaattccaggatgaggactctgggcttaatctgaaaagtgttgggcagccattctcgtttcttaggaagggagaaagacggattgatatggcagaggtatgcagggtagatcagaatgggatgataccaaagtcagggtagcaagttatgagacttatggaatgatgctttgtaagagttgataaagacctaaaccagagtagtggcagcacaaatgggagggaagaacacaacaggcactgctagaaaggaaacgataggaaacattgaacttttaaatataaaagacgaatgagagagagggaagactcagtgaagacattcaggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattatcaatagagttcttactttgtactgggcattattttaagccttcataagtattaactcacttaatcctcaaaaaaactttatgaggtagatactacttttatccccattttataaatgagagaacgatgttcagagaggttaaataacttgcttacaattgtccaactagtaaggggcacaggcaagattcaaatttagggagtctagtgccacagtctacacttttacaacaaagccaagcaatttcagctctatcagatgtttttattggcatgaccttacatttctaaataacatccttacattggtagttttaatttttttcaactttagacagtatcaattaacttctgcaaatttggactttttttctgccactacttctacaaatatttttatgccacttccttcctctctattcgggattccaattacatgtatatttggctgtctgaaattgtcctatagcttaccaatgctctatttttgttttgcagtctttttatttttttgccattgtgaaaacacatgcaagtgtgtttcattttggatagcttctattgatatatcttcaagttcactagccttttcttctgtgatacctaatctgctgttaacccctccagtgtattttttatcttagatattataactttcatctctagtttgatttgggtcttttaaaaaatgtcttccatatctcaagatattcaggctgggtgtggtggctcacacctttaatcacagcactctgggaggctgaggtgggaagatcacttgagaccagcctgggcaacatagcgagattccatctaaaaaaaaaaaaaaaaaagcctgcatctggtgacatgtgcctgtagtcctagctacttgggaggctgaagcaagaggatcttctgagcccaggagttcaagggtacagtgggtcacgatgctgccactgcactccagcctgggcaacaggacaatgtcttgtctctgaaaacaaaaaaagatatttagcctttcctctagctttctgaacatatggaatacagttaaaataattgcttttatgtccttgcttgctaattctaatacctgtgtcatatctgggtccgtttcaattggttgccttttcttctcattatggattgtattttcttgattttttgcctatcaggtaattttttactggatatcagacttgttaattttctctttcgggatgctgtatatttttgtattcctataaatattcttaaactttgttctgagacacagttaagttacttgaaaacagcttgatcctttcaagtcttggttttcagatttgataggtgagatcagagcaatgtttagtctagagacaatttttctccactactgaggcaaaacccttctgagtactctattccagtgtcctgtgagtcatgagattttccagtttagctggtaggaacacacactattgctagacctatgtgagtaccagggattgttccctcttatctttttgggtggctctttccccagcattatgcagtttcctcgcatgcatttgttgatcagtattctgttgactactagagggaaactctgaaggtctctagaattctctctgcagctttttcctctctggtactatgtcctgtgaactccagccaacttcgtccacttggattctcagctctgtctccttaattttagggaactcattgggctctgcctggatttccccttcctgtaccacttgattcccttaagcttttcaaacaaacgctcctgtagtttcttaagaaagagtacatgggaagtaaattttcaagaactttttgcctaaaaatatttcaagttaattttcacacttgataggttggaaataaattttgaaggcatgacttcattgtctcctggcttccattattgtgttgagacgttcactgccgttttgaatccagatcttttgaatataacctatgttttaaaatccagaagcttaaacaaaagttaatattacttttaattgacaaatcatagttgtatacattaatgggttgcaatgtgatgttttcatatatgcatacaatgtggaatgactaatcaaagccaattaacatatccattacctcaccattttttgtggtcagccattgagatttactcttttagctattttgaaacatacaatatgttattattgattatattcacactgctgcacaacagatctcagaaacttattcctcctgtctaactgaaactttataccctttgtccaacaactccccattccctcctcataccagcctctagtaaccaccattctactctctatttctatgagtttgattttttcagattccacctatgtgcgagatcatatggtatttgtctttctgtgcctggcttattttacttagcatacatcctccaggttcatttatgctgtcaaggataacaggatttcctccaacttcagtggctgaaaggtattacattatgtatctataccacattttctttatccattcatccattgatagaaacttaggtagataccatatcttggctattctgaataatgcttcagtgaacatgggaatgcagatatttctttgacatattgatttcaacttctttggatatatactgactagtgggattgctggatcctacagtagttctatttttagttttttgaggaacctccatactgttttttataatggctgtactaatttatattcccaccaacaatgtataagggttcccttttctctacatcctcaccagcacttatccttcctccttttaataatagccattacgatctagaagttttaaagatcttatctttaacccagtttttctgaaatttcatcaagatttgcctctgttatagattttcctttcctttcctttcctttcctttcctttcctttcctttcctttcctttcctttcctttcctttccctctctctttctccctctctctctctttccttctttctttcttcttgttctgttgcccaggctggagtgcagtggcacgatctcagctcactgcaatctctgcctcccagattcaagtgattcttctgcctcagcctccctggtagctgggactacaggctcacgccattacgcccggctaattttggtatttttagtagagatgtggtttcaccatgttggccagggtggtctcgaactcctgatctccagtgatctgcccaccttggcctcccaaagtgctgagattacaggtgtgagccaccgtgtctggcgcgttgtggactttttgtcattcatttttcctgggcactcagtgaatctttctaatctaaagactggtgacctctagctctgggaaatgttcttgtattatttgctaataatttcctcccctttattctttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagagatatgcctttccccttacaaatgacaccttatattatgtgcaatagaaaccaaggccttgagagactgcaacaagatcgctaatgttgtgttttgcttaaataaaaaaacacagacagtcagatacacacacacacacaccccaccatgtcacttttaacccattcttaacctttggtccatcattaacatttaggaatatggtattctaatatttctatttagatatatttcacaaacatgatatgctatatatactatattatactctacatttgaaacaatgtatcacaaacttttctctatatcattggatattataaaacctgatttccaattgcttcatgttattttatcttttgatgtatagtacattacttaactcagtctccactgttagacaatcaggctacatatggtgtgttgagtgcccttgtagttctatctttgcatacatctcaattatttccataataaaaattttatgaaatagaactgtggtgtcaaagaagacttatattttaagctattttgaaatttaatgctaatttggccttcaaaatatgtatcaatttcaatcctaatacaaatatgtaggcattattgactataggcataaaagctcctatgctgtcatttgtttgtaatttaaacgctatctcattttaatttacatttctttgatttctcataaagttggactttttaaatatatttattggccatttgtttgctttgactttgttttctttgatgctttgtgaattaaccctttttgttttgtttgtttacactcatgcttattccaagacactttaaaatctggtctctttgcctccaattttgaccctttccaatccctccactgaagccatagtagtattcctgaaacatgaatttcagcatattatttccccacctaatgcttagtgacccccatcgttcttaagataaaatccaacgtttgtaacgtggcctacaaagtcctgcatgattttgtctcattctccaggcttcaaacaagagagaacacacacacatccacatagtctttgcttagttaactcttactcattacataggtcattggtgaaaatcgacttccacatgggagatttcccttagctcccaagtctctttagataactcctgtgtatgctctactccctttgtagcagcacttctattgcccacgtaatgtctttctccttcatgatgtgtgagctcttgaaggcaagaaccacagcaaagcttgttcactttgtgtatctccagtgcccagtacagtgcctggcacattagttgtgcttaataagtattggatagatggatggaggaaataaagaagattggagaggccagaaagaaattccatgagctaattttctagattaactgttatcctaaagaagttgttgtctccttactcaccaaatcctggctattcatgtgagaccttatgattgtactgagctagtctttcatttggcctgtagtttatcactgaaacatctctattttcagaaacaataagaggtgttgttggtagatgtatagcagggtatatgtacatgaggatatgtatttttcagtttcccattcccttacaactagttcaccataaaagtttcctctctggtcttcctacattcaatgccttttctctctcctctaacctacatattattgccaagtgaatttttctttcctcaccatcatttacatgttcaaggatctcattggctctgatttagaagatcttgcacaggactaaaacatgtatattttggcaaaagctcctccagataatcctgatgtgtagcgatggctaaaaattgctgaaatatataaaatatacctcaattttttgaagaaaagaacagtctaaatggttaaggttatagaatttagaatcagatggacatgggctcaattatatttctgactcttactggttgtgtgatcttggacaagttacttagcattttaatgtgccaactttctcattcgcaaaatggaaataacatctactacatagtgttatggtaaagagtaaattagatagtgtatgtaaagtgaatgcacagagcattgtatatactaagcacccaataaatgttagcagttattttgttgttagtcattcaattgttcattcaacaattattttttcactatgtgtcaaatgctgtgttagggccatggaagatattaagaggtacaaaatatgaaccctgctcttgagactcctagatttagttgggaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatactgggctaggagatggaaactgccacattgctctaattgctaactttttaaagctctagtgatatcagcattatgcatctaagtgtaaactatttaaggaataaacatatatcctatttgttatatatcatatatggtgtcttacacaactcagataattcataaatgtttatttctctctcctttccactgtctcacaggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 3598 - DNA, 101314 bp, human
agaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagatgagtggtgttgagacaagaaattccagctgtaattatcttcttgtacagatagctaatctactttttatttacctcctcaatatattaaatatgttcctttctccactttcatgtattaaaactctgctaagagttttctgtgggcttaagtagtctgtggctgtttctatttgtttctctctttctgtcttccccttctttatgaccataggcagatataatccttttgatgatgaatctcccagatgctgagttttcttttagaaattctataaattactaagactactagatagtataagatgcttaaagtgtgggtggtggagggattttgagtaatgtgccagcatcccattatttccttttccttgtgggattcacctgaatacactctaggatgctggttcagcctaagtgggttggcaaagtatcatttgtaagcattatcctacttgggttctggcctccctgcagagctctggctgcctgaccttgggctttgtctcagcttccttcccgtaggtcagactccgctggttgatgaacggcatccccagtctctggatcatcgtcttactgagaccgaacaatctgataacaaacccatcatacaatctgaaatcgtcctgaaacatgaaatcccagtatttgcaatttgcctggataggagcataatgtatgggcatggcagacaatgctaattcatgacagtgaagtgtcttaatatatacagcacagagatagaaaaatggtttacgatccagatccttgatcactttgtgtatagccctttgttcagtgttgctaggatccatgtggttcccagggaagtagaagcttgatttcaaataggcctctgttctctgtcccttgtttctgacctgaacttggggtcctctcagcctaacattcaataacatgtcttacatacatatattgccatttttattgtgtagatgactgcctgtccaggtgaaccactgaacatttaaaaacttacaaatattttgttgggtaacagaggttaggaaaagcaatcctagaggagatggaaagctgtaccagtagtcataggtaaattaagtttgttttccatttgttcctcaaccctgcaactgccagtgtaatctgcattaagataaaggtgttatgaattgtatttaggattcctgtcaattatcatgtgttaccttggcaaatccatttgttggttacttggattaaccttttgggtttgtagcagatttaggacttctagttctgctattttgatactcattttaatgtttatatgatgactatcttgtataaaatactcaatgtttggatttaaaaactaattattgaaaagaacatacattaattccatgtactataaaatattaagtaggctttaataacctattagacaggagctggcactggtgctctctgccagtcggtaatcagcctccagttctgagttctccctgtgcaggatgaaagtttaagagaaaagaaaagagacagcccttcacttggagaggggtggggatcccagtctaaaagtgaagacatgagcataacaaataccatgatcagtcccatgatcttccagaagtcttgtggaggagtgtgattgtctgccattatgtcaaccatgtgtttgggatgaatttccaaacatttttggcttttcttaataacttgctttgtttctataatctatgaatgtatgatgagaatacctgtatttgtaaagtaaactaatacttttattttatcctcgtctgatcctcacaatagcccgtgagatgggcagggcaggtatttttcatctgatagatgaaaaagctgtggcccaaagagtttaaatgtacctaggattgctcggctaatttggtttagatccaggactacaaccaggctgtattatgagggtcaaatgagataatggctttgaaataatttgaaaagtataaattgatatacaaatgtaaggtggctattatcaattattattactgaccacctagcctcttctgtctaggtttctattttcagttcttatcctatagtgtgtgaattcgatgcattggttgccttttgtgttccaaaatgatctgctttgagcttcaaggggttcttttctaatcatggtgttctagaatttggattttggtttcttttacagcccccaaatatattctcattagtttatattcccatgggactcttctcccctttagttgtcctctggaacatccattatgtcttttttgagatacaacagacaaaaaccactgtactttgagcatcttagtaatgcattttgtttatgtcctgctccagtggctgtgatgtctatcacttgttagccttcctagtcacactaataaataaaagttgtgtttttaggagctagtttacaataatccaagctgtctttttatgtggtaacagatagcaagagctctataataatcggatgtcagagctggaaagcatcttaaagagatcgtctggtgattctagtttagcttgaacattttacagttgaggaaacatcagactaggccaggactcatttgctccttaccccaaggcagggagacagtttctaatactttaaggaagaactcatgggacattaattttaatatcctgaagaatgtttattttatatatatatatatatattttttttaaaaacctacagctcagctcatttctcaatctacagcccagagatcaggcttggtttcacactcatggattttctatgaagggaatactataactcctcaggaaggtagtgggagctcagatacatgctttgcagacccggaagaaaaaaaattagatggaataataattgttaattaagtgggcatttaattatgctcaagtaacctttgaaataatagaattatgcaaagtacagatcacgacttctctcttgatcagagttagctaaaggctagatttggaggacaatgctgaaatcagtcttttatttcataagtgtaggatgcattatttttacgtttttgaaatttattttttatttttatttattttgagacaaagtctcatgctgtcacccaggatggaatacagtggcacaattacggcttactgcagcttcgacctgctggactcaagcgattttcccacctcagcctctcaagtagctgggactacaggtgcatgccaccacaccccactaatttttgtatattttgtagatatggggtcttgccatgttgccctggctggtctcgaattcctaggctcaagcaatctgcctgcctctgcctcccaaagtgctgggactacaggtgtgagtcaccacgccagacccattattttttatcttaatcaccttcatcaaaactccttttgtatttctacccagttatacagcccaatggtaccttcttctagtttatgctcatcgacttcttttttcagaggtctcaccctgtagtaaggcacaaggtaaagaaaagccatacagaaacaaacatacatatctgactatatatggcagtaactaaatggtttggaagggaactaatcagggtgtgtggatgtggacatttgtttcttaatatggcaattgatcgtgccctctcaggtatttcatcaatgcgtttttatgacaaattgtaaaaactttcaagattacctgtcattgagttgcaccctatcagattcacatcctgtcttcatccttagcatactctctaactctgtatagattagtgattcacaaactttttgaaattgcaacagtttgccattgtttaatttttgtcatgccacttcctcctgctaaaagtatttcatgataataggagtcaaatatttttcaggagtcacttatatactttttaaagtgaataaaaattgggagctgagaattttgtaacactcattgatcactagagatatcccagggtattgcaaaacctagacagggaatcattgacctagaaaaacaattgaaaggaacaagcaatccaatagaatttataaatactatataatcacacagttgttagtatagtatagtgatttgctgtttacaccctggagtcagacagacctgggattgaatctcttctttaaaaaaattagatgtaattcacatgccataatattcactattttaaagtatacaattcagtggtttttggtatcttcacaaagttgtgcaatcatcgtcactatctaattttagaaccttttcatcatcccagaaagtaactccatatttgttagcaatcactcctcatcccccatcctcccctgccctgctcctggcaaccattaatctactttctgttcctttgggtttgcctattctggatatttcataaaaaaggaatcatacacaaaaggagccttttgtgactggcttcttttacttactgttttcaaagatcatccatgttgaagtatgtatcagaacttcattcctttttatagccaagtaatattccactgtgtctatcctttcatcagttgatggacatttgggcttttcccttttggctactatgaagactgctgctatgaacatttgtgtacaagtttttgagtgaacacattttccattcttttgggtatatacctaggagtggaattatatggtaactctacatttagccttttgaggaactgtcgaactatttcccaaaagcagctgcaccattttttatttctacctgcaatgtatgagggttctaacttctccaaatcctggctgacgtgctgttttccggtttttgtttgttttgttttattatattttagccttcttagtgtgaagtagtatctcaatgtggttttgatttgcattttcctactggctaattatgttgagcaccttttcatgtgattattggccatttgtatatctttggaaaaaatctattgaaatcctttgcctactattaaattgagttactcatcttttttaatcttgagttgtaagagtacatttctagagactagacctatatcagatataataatatgatttgcaaatatttgcgcctagtctgtgggttgtctttttacttcattgatggtgctttttgcagcactcaaattttaaattttgataaagtaccatttatgtatattttctttggttgcttatgcttttggtgtcatctgagaaactgttgcctgcctaacctaagttcacaaagatttatgcctatctttccttccaagagttttatagtttcagctcttacatttagatcattgatctgttgtgagttaatttttataaatgatatgaagtagaactccaacttcatcctcttgcatgtggatatccagttgtccaagcaccatttgttgaaaagagtattctttctccatcgaatggtcttggaacccttgttgaaaatcagttgaccatagatatatataggtttatttctaaagttttatcctaagtttgattcttagttttgccacttagaaacaagtgtgaccttgaacaagttactttttttttttttgagacggagcctcgctctgttgccaggctggagtgcaatgacacgatctcggctcaagcaacctccgcctcccgggttcaagcaattcccctgccttagcctcccgagtagctgggactacaggcatgcgccactacgcctgctaattttttgtattttagtagagacggggtttcaccatgttggccaggatggtctcgatctcctgaccttgtgatccgcctgcctcaacctctcaaagtgttgggattataggcgtgagccaccacgcccagcctacttttttttttttttaaataatgataatacctaccttttagagagttgttgtgaaaagtaaatgaggcaatgcgcataaagggtattgttcaggtgcttagataaccagaaaggtaggggaaatgggggataattgaaaggattctaaaatattaggagtacccagaacaagaaagcctcataaattagagatgattgaacacgtctgaagaagttgataaaagtattcagtacccgaaaattggctaaaacagttaatatatgataattaaaaatcaaacagattcgaaacagtctagaaaagctaaaataagcaagaggcagtaactatcttaaaatattctttacagagctgaaataagttaaggtaggttattttagagtactaatgattgggtttttttctttcaaagactcttgagaatcttttgaaagctatgggcaaccctttccccaggaaaaatgcatatatgacatacaaacacattctgcaaacagttctaggaagttcagaagtccccggttaataaatcctattttgaccttacccaaagcaatcctgacccatagcgtgctttcccaagcttaatttcataatgaggttcaagtgtcacactgacttggaaataaattttagatttccaaacaaaatttaagagcttttcctctgtacaggacaatttatatggcaccctcttaagccttaggaaagctgtggtactctaattgttgttatatagttttcagcatacatagacatggctttcagcaatacatgtgaccaacccaggtagcttccaacacagacattgaggaatgcaggcatacagttctagaagagatagtaatagaagtgcagtgtgaggtggagatgggcctagaagacagagatatgattctggaaggaactcagaatgaaataggcagattcagagaaagtaagagagacagagagagataaaaatagacgtagaaacatgctgtttaaaaaaaaaaaactctataaactatgttaaatataccaaagtaaagatttccagaattcaaaaaaaaaaaaaactgtcttgtaaatggtccagataaacctcagtgaaggaggtgagatgattgaaataaaggtaagggaaaagagcacaggcattggaattatactgacctgtgctctgggtatgtatgtttttggttgatttatttaatgattctaagccctagtttcctaactgtaaggtggatacagtaatagtaacttcctcacaagtttcctgaaagaattagtgaaataatgtgtaaagtgcttaacatagtactcagaatacaggagatgctcaatgaatgctagaccccttcttactcctagtttaagtgatacttcattaacaattattgaatacagtttgtgtgaagcacaaacttgtgctgtgaatgaaaatataaaatagttgatactctcaaggagaaggaagagttagctggaaatacagctatgtaagtgaaataaaacagaatgttctggaagccaccagtggttgaggtgataaaaacatgtagatgagagatctcttagatttctaggcttggatggtgatattcaccagacagggaaaatcagaagaggagcaggtgttttttgtttgttttgttttgtggaggtgaggaggagcacaacaagttcatttatagacatgttgagtttgagaatctgagtaatatatcaaatggagctctctaaggcaatattcctgctgtcagtggaagttggaatcttcatctctcaaaagtctcttccaattctaagattcaatgatgtatgtacattttaattgtttactttttcatctgtatgggtgaacgttgatagatgttataagctacaaaatactggccaacaactttcaagcacctgtaaattctaaaagaaaaataccttgtctcacttaaaaaaactggctgtacaaacatctgaatctactaaaccaactgagtgactgatttacaaaaagattcttcacttttataacctcatttcatatagattttcattaaataggtagttagttcagtgcatttaaaaggtttgatttagaaacagcttttaggtgtacatctattgtacttaggcataaagtataattgtactcagtacttatgtatcctgtgacaatatctgaacaaataccaatggcagagcaaaattttcaagctctgatgagagtctccaatgatgacaagataataaacaaaagctactcaaaagcaaacaatgcttttcttgggcttggctctgtggctcactcctgtaatcccagcactttgggaggctgtggtgggcagattgcttgagcccaggagttcaagatcagcctgggcaacatggcaaaaccacgtctctacaaaaaatataaacaaaaattagctgggcttggtggcatacccctggagttccaggaggcggagcccaggaggctgaagcaggaggatcgcttgagcccaggaggtggacgttgcagttagccaagattgtaccactgcactccaccctgaatgacagagggacaccttgttaaaaaaaaaagcaagaaagatgccctttttctttcctatacataggattaacattttcagtcagtaagatatgttttatatttttccttagttaaagacaacttagaatatttatgtgtgtgtattttaattaatggaagactctaggcaattaagaattaggtacctgtgtgttcagcacagaaatgcctgtggaaaaatagatagagttaccaagaggttggtttcttgtcagttgggtggctttttttgtttgttttgtttgttttttttttttttggcagtctcactctgtcacccaggcaagagtgcagtggcatgatctcggcttactgcaacctccacctcccaggttcaagcgatacttctggttcagcctcccgagtagctgggaccacaggcaagcgccaccacgcccagctaatttttgcatttttagtagagacagggtttcaccatattggccaggaaggtctggacctcctaacctcgtgatccacccaccttggcctcccaaagtgctgggattacaggcgtgagccactgtgcccggccgggtgacctcttttactcactgatgctcactaaattgaaggttaccagatcttaaaatttctggaactttgctaatttctatctagatattgatttgcatcctgttatgttttagaaagtatgaaaagacacatgggaggtgagcttcatagctggcttgtgctagttcagcaggtgtttagtaatgaaaccaaactgaagccacaaggcaatatgactttattattgatcagcaactattgctgagtaggttgaaaagtttgaaatcattccccattcagcttgatgaactgaaggggtttctgaaggtgagggaagaagatgaaagtgaaaactatcatcttttatctcaagtaactcagtttactaggaatagaatggaacggaaatttccatgtgtgataataagaagtaattcaagttcacactctgaggaaaaacttattatcctgcaccaagggctacatttttctaaagctctctcttttttatgcaggctttcagaatggaatcatttcaggaagtagagagttactttaaaatatggcattgttttccttacactggatgtcacatagaagcagccctacagtttaccttgaagtgaaatagagaacaatattggagaatagagattgggaattttgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcagatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatcggtaatttttggagaaagaaagccagattttgaatagttcccctttcatattttaggaaatgtgcagaaaattctgattataaattaagtggaaactatttttactcatttttggatggagagtggaaaatgaatcattcccaactgtgtggttcgttatgttgtctgaaacatcttggactttggggaggtgagagaggtactggttgtgtgtgtgttgcgggggtggaggggtcactttggtttggtgccaagtgtaaaagaatattaattctccatgttaagcagagagaaagtctgacttttagtgtcacatatactcacttctttgggttaattttaaattggaaaatcatttaggattacccccttagtctgcttgattcttccccaaggagaaagggagaaagttggctggcaggagctatgggagagtctgcctgagtatattcccctggccctggccctgagagaagcacaggagtcctgtaggagatatatactataccctatcattcttccccatactatcattcttcccctgtatctaggaggttggctttttagccagtatctgataacagggtttatttttactttttggttctggaacttcactgttgacatttgtaactactttttatatacgaacctccctgattaggattagtggcttctaatatttatttgttcaataaagaataaataaaccattatgttatagatgaaaagtcagaataaccagaaactagcctgtctttttaacatgttctcaaagtggattagagggcttggggtacttagtttagtttcatgatcttatttagttgtccagtctaccaatagggttgagacgcaggacacatgtctttcagcaggctaccagtagttcaattaattattcaattttaaataatatttttattcacgacagttattagagcagtaagtcctatcagagtaattattttctccatcacctctcacttttcactcactagtcccaatatatatcttagttcatgatatatggggcatttctataaaacggcttcatattttagaattttcattatcacatgagtttccatccttataaaagattgttgttatcgttttaataaattttggcttcataaaagaggccaaatttcggtgactgtctattgctgatagacttcaactcaatattataagtcccatacaacttttttcttgtgctgcccatgtattttcccctctactcctctaaaacatgctaccttcatctaccccagtgagcctcctgtctgcaaaatataccattctcttttctgattcttaactgtcactagtgttcttctcttggcctgtttacaaatcctacgtattctttaatgcataattcaaaccccataagaccactccaaaacatcacagctacgtcataatctccttcaggtcagaaataatgtcttgtatttctttagtattctccttagtttctagtacacatagtattttctcaagaaatccaaatgaattcagtcttcataatggatttgcaggaaatataccagtgcctatagcttgctttggatctcatctaagaagatataaatctgtcttgccattatatataccctgaaagtctgaaaaaagatctcctgtgaactactgacaatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagggtgggttaccataggtgagggaaaagaaaaatgttgtttctcactctcagtcaggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgccatgacagaggtttgcacaggatgctctgaagcacagtggaggggtcagggaaaggatatcattgagttcaaaaacagggaatcatgagtgaatttattggagaagaaggaccaaaccggagagagtccatgcggaaagaattgacaaaacttggtgaatgactatgatgattatacaccatgaagagaatgaattaaaaaggacttttgaggtggagatgtcttgaaggatggtggtattgaggaggacaaaaatgaaattaggaaggggtggcagttttttggggatgctttgactttagatttgagtctgatgtgattgtgggtcatttaacaatcattcattcatcaaacatttcttgaacatctattaggtggcaagcacccggataggtattagggttacagtgattaagaaagcacagcctcaaccctgatggagctctcaggttagtgtggggaggcagataattaaggacacagttatgagatggtgtggtaagtgcaatgacagtggaagaacaggggctgttacagaacataggaggaatagcaagatagaatttgggtgagtttttgaatgccctgttaggggacaggagttgaggcagggaaggggagtgctctagtcaggagaaaagagtttgttgaaacatctggaggacagagagcatgggggtttctcagaactgaaagggcaagtgtcctagaaagggttaaaatttaggctttaccagtggctgaaagattgggtctggagaaatagacttgggagtcctcagcgtggtggtagagccatgcagtagtgagctgagcaaaggccaaggattgagccttgcagaacactcgtggtctagaaattaggcatgaaggaatagaagttgaaagagaaagagggggatgtgtatgagaggcaggaagtgaagaggaatagtgcaagtggaatacaaccctgagtcctccaggaaagtagagttggctttggctcactagtctgagggttatcaaaataaacactagatttaagtttttagtacaggtttacttttagaatgtccaaataataatgtatccatttgagctagagatgtaatcatgctatgcacctgaagatgggggaaagaaaagaatatgggaaggtttgggcagcatttctgataaggagagtgggggaggtgtgggtctcagctggatgatcacagagccttttgaaaagatggcaagtctttcacctggcttgagggtcaggttattctttaacaaacctgaagtagagtagacctatatgatatacatccagtgtatcaccttcatctcattctgggacgtagcctgtgtctatacaacagcaaataaatgtttggggaaagaataaattctggcataagggtgtgggcttcagtttgtgaaccagatggcatgttctgttgttgagaggccatatgtaattgatacataaagtgacagactgaagcaaaagcaaagtaagtattttaagacaagcagttaaaaaaagaaagcagactgtgaccctaaaagcatgtgaagattctggcttctggcttttggaagagctgaaaatgtcggtgcatagacaggatgtcaaaaaagagcatgtcaaagaatagtaatggggccactggctcagattatttttaaagatgaagttgtcttctgtcaatcaggaagactcaggtttgggatgaattggcctttctgccctatttcacttctccccttcctatgctcaccccaaggttcaattcccacataaaagcagtcaggatcttgtctaggtttagataatattccccttgtaccttttagacagcaagagagaatacagacattctatgacagtgccatgtttcagtggaaatgatatgtttcaatagaactaatacagattacacccccttttaggcttcagtacttactgtgtcaggttgatgtgtgtaggagtgctcatatatgtgcgaatacatatgccttcatggagtatgacaaatggagatcatggtccagtttgtgccataatggggtaatctacctcgctttaataaagaggtggtgtcttgatgtacgcctagttttcttgagagagtcaatgagaaagttacctgaaataatctgtgtctagagaagtgaaaaaaaaaaaccagcaattatttgagggttgaagaagccatttctgttaatgggatgctgtctggaagaagaatagcctgtgcccagctttctcagatggcaaaacattttcctctttgggaagggaataagagagcacaaagaggcctaatctatacaacacaataaaacttgggtaaaaatggaatcagtgtagactgccaatttagctaactgaggccttttaaaatctgttatgcaaatcagccaaatctttcccttactttgtgctgtttagacacatgtacaattttgtgtgagctagcataatgtagtcatctggaggtgaagaaggtatcacagtttcataaactaaaatggcttctgtaacatccataaaagggaagcacacaaagacccagaggtaacctcttgcagcaggaaatgggagcttcatcctgccccctggctgccaacctcctgtcctgtttcctaccagcagatatctccattccaatctcccctgccactttggctctcttgctgtcacggtttaactgtcctgagaaagttgcactaaccgggcttgaacataaggaacctggcccagtcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgctaggcatgataaggaagagtgacttccttagattgcataatcgcttcaattctctgtttccctttgcatatgttcattattgagaataaattccaatttgagaggaggctttaattccttgtaaatgaataggaaatgagtaagtaaatgttcggtgttttcctcaaattatgtctcatattgtaagaaaacagtggcaaaaagccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaatatgccatatattttatttctttatactttttatttatttatttatttatttatttatttatttatttatttattatttttttgagacagagtttcactctttttgcccaggctggagtgcaatagtacgatctcggctcactgcaacctccgcctctgcggttcaagtgattttcctgcctcagcctcccgagtagctgagattacatgtgtctaccgccatgcctggctaattttatatttttagtagagaagaggtttcaccatgttggccaggctggtcttgaactcctgacctcaggtgatccacccacctcggtctcccaaagtgctgggattacaggtatgagccacccactgctcatggtcttatttctttgtacttttctcattacattccttgtgcccggaacatcctgcccccatgcatctctgtctattaaaattctgtttatccttcaaggcccatcttaattttacttcctctttatctgtgaagtcactgtaccttgaacagagtaggtgttcaatacatttttgtattaaatttctgaactgccactttttttattcctctgacatcaatttagcttagagatcacgtccaaatcaatgattgcttcctgtattcttcttccttccccttttctttgccaagaagaccacagattgagatggtagtgggattaaaggaggccaggggagacattgtgccccaatacaagaaaaatagaataaatggtgaaaaatcacttccatgggaataaagccaaggaagccaagagagacctggcaggaagggtagcaagggttcagctggtcctcataatccagtttgagaaaatgtgaaatcacactacccagcctgcaaacacgtgtatctatgtgaatatatccatctattcatgggaacagtgccaaagatattaaggagctacaggtacttagcagacagaaaggggccaagtacacaaatctcttcttttccttcatgttccctctctcccccacatccccccatccactttttcaaaagcacgaactttgaactacaaaacataggaacaatggagatagcagcgtagcacttaacatgactgagggaaggactgctagcagaatgagggccagtaagttggggtattacatttggaacagactttatggggtattgggatagtgggtgagagagaagtagatattggggtgagtcttagaggaaaagcagctaccagggctgaaagacttgggagtggggagaaataaaaaagcccatgattaatctagagtgaaatgatactctttttcacataacgaatgggaaacagtagcttgctcaactgaaaacatgctagaattccggctactgttgtaacaacattatattcaacagatctgcaaagtacccctaatatgtacctgaaagaatctatgtaccagtaaatgatgatatgcaatggatatcttctctttttaaaatatttatttattgagatagggtctcactctgtcacccaggctggagtgcagtggtgtgatcctggctcactgcaacctctgcctcctggggtcaagtgatcctcccacctcagcctcctgagtcactggaactataggtgcatgccaccacgcccaactaaattttgcattttttgttgagatgtggttttgttgtgctgcccaagctggtcttgaactcctgggctcaagcgatctgcccacctcagcctcccaaagtgctgggattacaggcgtgaaccaccgtgcctggctgatgtcctctcttgatacagtcaggctttgcattttgaagccctgcctctcttgtgggtgaagcctcggtgccaaagaaggaaagctgtgagatacaatgctagattttgatgaattccacactcaaaatactctttttttcctgaaggaccctactgataaatataaaatattataatcaaaaacaaaaaaagtcatggaatactgcagcaaaactgtgactgagggctggatacatgggttccagtcctagttttgcacatgctagtaatatgactgtgcaaaatactttaactccactttgaagcttggtactcccatttgtaaaatactagcatcttctactttgtgagattgttatggtttttaaatagtatatatgaaattgcctggcatagtgtctggcaatcattcaataattacagatggtccctgacttaccatagttcaacttacgatttttcaatttgacagtggtgtgaaagtaatatgcgttcagtatgcttcttgacttatgttagggttacatctggataagtccatcataagttgaaaatttcttaagttgaaaatgctctctctggaacataacttcatcataagttgagggacatgtgtaatagttttcttagtctactcatctggaaaagagataataatatctgttcttcatatgctgtgggattactatgagggcgaaatgagatattgcctatgaaatactttgaaaagttaaagatattatctaaaacataaggtttctttaatgtcaataaattcctacatccacaaagtcatgaatgtcatattttccccaatagtgagcaaatgtgcagcattattaatttgtacgtagattagtgcttggctcatggcagatgctaaatgaatctttgaaacatttgtctactgactaaccgattttcacatgacattggttctcaagctcatggttcttttttcccctcttctcggttcccctctggattcataccctctgcgatgacagcaaactctggagatgaacctcaccaacctggttaagcgcaacagcgaactagaaaatcaaatggccaaactaatacagatctgccagcaggttgaggtatgtaacagaaacatttgtgatttttcagaggacctgaaatgggtgaccctttgggaggacttcagttttgtcagagtgtagcctagtcatttggaatgaaggattgaatggcagttttagaaagtctcattcctttaggatgcttgttccaaaaaaagtgtcagaaacctatggtttaaaaagaatagacggtgatgatggacagtggggggataatagttcaaggggcaacctattctcctttccaaacagcaggcaatatgaaaatcagacatgaagtgtgcttcatccatcatcaaactggacattatcactccttaaagagattactggagtgtcatagggaagttgggaatcctgggtccttggggtaaggtgaggttaattcagcacaatattgtttctgtaacaatattatcaggactgcttctcctctttcgagcctctccccctcttcatcccctgcccatggtcctatctataccatgcaccccacctggtcctcactcattacctttccacttattcttgtcatcaacaaatcatatctattttaaagttgtaaattgtaaagtgctgtaaagtgtgaggttttaatcaattgtcatctacatcaaatcttagagcagagcttagaggaagagctgacctcttcttaaatggacataataaaataaagatgttatttctctttctcaagagcatgaaacttataccatttggttttgtgttgattttgttgaagagctgatggtagggcttcaagtgtaaacagggttgggtaaaatattataggattcttcatgggcagtggttggataaaaatgtttctaattctatttagaacctgatagtctggttctaatcttacttgtatgacagacaaatgtaacagttcaagtttattttatttcaattttattaagatctcatctcttaatccaatctatagattcctatttaagagactgtggagaatcttcttgtaaggcaaagaatcctcttattatatgagtaaccttctgacccccaatcatttggatttcttaaagtattgagtttcttcaagtagagtgtacttgtatgatgagcataccatagaaatttaatccctgctgggcactccatttgtggaagagagtggtgctctacgtagggtccatagagtactggtcaaactcagatatgagactataaaatgaagtgggggattagggaagaagcataaggaatgaaaagaaagagcactagagtgtgatttggaaaactgtgctctagacttggctcttccatgaagtggtggtatgaatctaagtcatttagcttctcagtttcagtgttcttacctataaaatgaagagttgaactgataacatgaccttcgacttctttctaggtatcacaggtcatgatgctgtgaatggtaactttctttattctattctttttctctcctggcttattctttccaagaagggagaaacaaaatataaagtatttcaaagtggctttcagctaatcagaatccctctaatgttccactctgtcaaagtttctcattatgctgttagattacagtataagacatccacactggcaaagggacaagggagtattgtaagcaggagacaagataagagatcccttgatttagaatttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttgcccaggctggtcttgaactcctgagctcaggcaatccacccgccttggcctcccaaagtgctaggattacaggcgtgagccaccgggcccggccaacttcctcttaataataacaacggtgaatccaggttacttattatcctcattcaacacagagcctgtctctccaaaagccttcaggacaaacctcaggattagaaatctagttaatggagggacttgagacttcataaatgcttaaaaatacagtagaaaatgaaatgtatagtagaatactgtcagtcatgaaagtaagacactgatgggtgatttggaattttttcattatatgtaatccagattcatctatagggaatgactatattcacagtgtataccaggcatttcacattcggcgggggcggaggataccagctaaggcgcttctgagaaaactggaatagggtattttcctgtcaaacctgttccccttctttattgtctgtaaatgtttttgtcacaaattgccttttcataaaagggccataaatactgcctccctatcatggttctttctccctgttctctattctcctcagaaagtaaacaaagctgcagtcttcctattataacagaaacagagattaagatcactacagatttgttagctgacttctatggtaatgtagcttgttataattgctgctgaaggtttcagaattcagtagatgggtggttggaaaatgttttctgctgcggctggagagcatgggaaggaggtagaggcagctccaagactccctttaatctaattaaggaagggcatgctttgaccttgctatgataaccacttgatctctatatatagttctttgtcctggctcatcaggcatcctttgtttacatttccaaaggaaacctctgtataatgcatagccaagggaaaatgtataccaacagatgaatacttcctcttcgcttccaatactccatggttctgtgaataataggcattctaaaacatagcgaggggcaaatatagttaaatacttagtaatcagttggtcaacagcatttattgagcatacgctgtgtactctgtggtgggcgatttgggggctacaaaagaaatatatgtggttgatgacctccaggaactttcagtctagttagggaaaacagtatatagtgagaaagagtatttatagagcagcatgcagtgcagaaaatacaaatgaatgtagtatagccctttcaattttacttatttagtcttgttcttagcttttagggcactgagtaaattaaaacactttcctgtatattttgtgtgccacctttttcttctttccagaactgctgtgatacaatggcttaatccatcccagaagctccatgggcaggttgatttccttctggctcttctcaatccttttaaagagctggacggcactgctctttagcattaggagaaagaagaaagaaaggagatgagttggaagagagggagaggtttcccttagtctggggaatttcagctttctgtcttgctactaggtcttagcttcattcacttttggaagtctctctctttagagttcaaacttcagatgggctggtattttcttctttctgctcgtattgcccattggaaggatatttagtttgggaagggcaagaatcttggagtctatgtaatagatgtctggctgcttctccaagcataaaatataaatattttaaaataaattaatttaaaaaacactgctatggatgatttcagcagatgatccttaaatatttttgggtggttgagctagaagaaagaatagaatttaaaccattagagcacaaatacatttgttggtggagccctctttaaggagcagtcagtgaaattagtataattggaaaatttaatggagaaaatgcattttagccaaatgttgaaggagaaaaaaaattactccctctggagagacagaaagcagaggtattagtggaggtgtaaatgagcacattttatggggaaaatggtgccttaagcactgggtgtatacagataaataggaaatggcacctgccctcaaggaacacacagactggctgagaacctgacaggtaaaatggcaaatagaatgtgaagtgataattactgtaatgaatgtaaatgcgtgatgacaagttagcatggaggaggaaacactcaggcctgcctgagaaacttaggaaaggctgcagaatggaaaaaaaatgagttatcttgaaataagagtagaattttgccaataaaaatgagataagggagtgaaggggaccacatgtgagaacacagaagggtgatcagcatggagacgttcagggaactatcagaagtttggcttggccagaatgtaagacatgagattgcaagaggtgagtatggagaagtgagtagcttgggcccaaataataaagagccttgtaggccatgtataggtgtttagactttaacctgagaagtctggggagccatggaaggattttaagcaggtgaataactgaataaaatctgtatttaagaaggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaattatagatggagaaaattgtttccatgaaaaatggaaaataagttcagtgatccagtcaatctattcatttatactactgtagtgactaattcagagtattacattcaatcttattaagaatataacgattgacatttaatatagatgaaaaacctaagttaactgtgcaatccagtgtgtggtcatagcctatttttatactagaaaagaaagtgctttataatttttcagagacctaatgcattcaatcctttttaaaaaatactttgtgacaattcttcatttatgtcagtaaagtaacatttttgaagacattaaatgttgcagttgaaatacttggagggtattaacacatgacagggtttaaggataaaattagttaggattaatattgttttcctcgccctcctccctcacatctatagggcaggtaagctttcaggtgtggtcatgtcttcatagccgaaacagttcacataggaatgcactttcatcccacttttgcacttttcctttggcacagtgaagcttatcttacagtcccgtttcccatccctcctctagttctcatttctgtgttcaaattccaggtcactcactaaatgaccagaagacttgcttaattttggctcctcttgtttgctccactattttcacaatccacccaaattccccatttccagtgtgctcttggaaagttaatggaatcttaataattcagctaaggctctatcaagcttatcctataccttgaaatgtttctagttccacttttacctctaatctctcctgccatcaacccaactaaaactaaacaaatgttttaaaaacccagacttgaaaccaaaacaactatcaccacagcagataggcacacagccattgagatgtccttactgtctctgcctgtctagaggagtccagctctgtggtacggtaagcaaggattgggaggaagagaatcttacttgaataatttgttctgggcactgtgctagagacatcatttctaatctcacttagtgtttatgacaatcctgtgatacagctggttaatattcccatttttcaagtgaggaacttgaaggccagagatattagatgccttactcaaggtcacacataagtaagctgggatgcagttctacatttctctcactccaaagtctatgttctttccattgcattgtgcagcctagtggagaagttgttggtttacttgccaccgattcatttgtgctcagataggtaggaggcagctccagaaaaccctttgtttttctccactaaatagctctagctctagaaaaacatatggtctgtttgggggcctggcgttcctgaatctgtggtaagcctcttatgtactcctgccattggcctacctttaatagcccagagcagctctccatattctgacagcccttcatggggtacagaggagagggagttgcctagagttggcagaaggaagcaataatacccacaattaggcatttacttgctcagattatttttgtgccatgaggggtggaaatagtgtgggcagctccaggtatcaacactgtcctcagccatagagtttacgctgggacccatattttcttgctgagactgccgggatgggtcctcattctagggctgtacatgaccatgtttcagggtaaaagtagtctccatgagacacagggtttcttaacagttactaagagtttgacagtaaagatgtactctcaaaagtataattaatgtttgcacatttaaaacaggatataaataacaaatataataccacaatgactgcaaatatatagatttcctcaaaaaagagtgaatgcattgctattattaatggtgtcttttgatggaatgattacttagaagtacacatacagccaggaaatcagctatttactacctcaagacagaaagagaatccaatgcctctgtctattctcactacctctcctctcacctaaatcaaatcttgaatccaagtttaccctatctcagccagtcctaagaactcttaattattcctaagagctttaaatacattagctcatttaatccacacaataacccaatgaagtacatatgattctcattctcattttacagatggggtaactgaagcacacaggggtaacttatttgtataaaatcacaggtggcaaattaagagtttgcatccaattttactgaggtccttgctcttaatgactatgctgtattaaaaaagatgggcaaaactaacaacccatggctccatgtgcagtgttttgcaagtcgctgattattgtgcttatggtctgggtaaggacagaaaaccagaaaaccagtattatgtgagcgtgtgcccatgtgggaatgatgtggtgtgatactagagcaatatttgggcaagcctttctttgtgatgataatctctccagagcatgcatcataatgcctctgcacgtgctatgcatctgtctatctatttcatagatggctgtgcctggctgttcatctcttatgtgtgtctggggagggggttgtatgtgtaaagaggatatatgtggaaaaaaggatatatgcccagtgagagaattagtgtttaaactgggtcatgaggattgctttgacctgtttccctccccgcccaccccaaagggttcttttcagtcctttgatgttttccccatataaggggagaaactgggacacaactggaggatgttgccttttgttttctttaatgagaaacattgactctttccttgagagaaggttttcctcctcttctccatatcccaagcctgttccagcttctccttagtaacatcaaaggcacaaaacaatcactggctttggaataatttctaaaccaataaaactctagctaaaagtgtatagcaccagtgctagtcgcatagaacaacatagttccatcctgagctccctcatcccaatctatatatgggtagttttgcactggcatagaatggcaggtttacgaatgtccaaagatgtcttattagaaaaatctcaggtacaggggaaagcccaggacacgaggaggattagagaagagggtgagtgacctaggcagggaaggataacaatgctatgtgaaaaggaaggagaaacaattacacgatgccagtttactctatagtgcacatataatgaaactcctgccaaatttgtggtgtgttctagcatctgaagagctttgaatcttctagcaccctggggatattctgggattccaattgccacccactcaacagtcaagaaattcaaaccatttcaggaggattccattggctttagaatgaaatggaatttatattatattggtagctcacagagaacacttacatttaagaagtaaaaatatatcacagatgaatacgcaaattgcatattgtctgcaggccagagagcaaaattaaacaccttcatgctttcgtactccatttctgtcaaaaacaggatatcagcagcaaagccactgaaaacacacacacacacacacacacacacacacacacacacacacacacacacacacaacactgacctacagtgagtactgccaaaccccatgctaacccagtgacacatcattagctcagaagttgaaagcaaatggtgttcctaagtggacctttataaaaaatattaagctccactgtgggtttagcatagtgttatgtgatacagaggaatatagtagcaggtgtattaagtctctatccctgtcttcaaggactttatagtctagttgagaaagcagagctaacagtatgaagcattgccaagcaatataaaataatttaaactgtgtgacaataactgtaagtgctgtagtagttcgggggagagggagatggaagaaggctaacatcattaccatcattaacatctattgtttattaacacttaatgtgctccaggtgtcatgccaagtgctttacatgtattatctcatttaatcttctcagttacctctgagacaggcactattattatccccatttttcagatgaggaaactcagatagctaaatgatttatccaaggggagtgtagaaatgagactagagaggcatggagggacctgattacagaggacattaaaagccatgctaagaagtttggcatttattctaaggtcaaagggaagccaattgaaatttagtatgaagccattttaagcacgggtgtagtgttttttgttttttgtttttgttttgttttgttttgagacggagtctccctttgtctccaggctggagttcagtggtgagatctcggctcactgcaacctccacctcccaggttcaagagattctcctgcctcagcctcccaagtagctgggattacaggcatgtgccgccacgcccagctaatttttttttttttttttgtatttttagtagagacggggtttcaccttgttggccaggatggtctcgatctcctgaccttgtgatccgcccacctcggcctcccaaagtgctggagttacaggcatgagccaccgcgcccggcctgtagtgtgttttttaaaaagtttatactgcccctctgctgggttaagtacacattgggaaaataaatgattggagacagaggggccaattaggagactgtagtagcattgtgcttggcacatagtaggcactcaatgtatatttgttggatggatatatgaattcagggaagagattttggtggacagatctagtgaaatataagggaagatgatagaaaaggatagatttgaattatatttatgaggtaaatataggggatgtgatgattaactggatgtggggaataagaaagagaagttaagaatgaagccctgggtttctgaggagctggtgatacccttcattcatttagggaacattagagaagaatcagatttaatggaacaggatgtaggaaagagacgagttcagtttggaaacactgagtttgtagtgcctgtagttatgcaaatgaaatgtccagtaagcagttagttatataggtctaaatttcaggagagagacttaggatagacataaatataattaaggcaaatggagatctttttgaggtgatggaattgttctaaaattggattgtggtaatggttacaaaattctgtaaatttactaaaattattgagttacccacttaaaatgggtgaattttgtggcatatacattatatatcaataaagctcttaaaattaaaaaagttaagcaaggtactggcatgtagagagtaactgaagccttagaaatggatgaggtcacctaagtcagtgtgctagaactctcagaatgctgacatttaagggacagacaaaggagttggaatgatcagcaggaaaactaggaaaatttgtctcatggaagctgaaagaagaaagtattttcagaagaagtgaatagatgatcttttaaataatgatttgaaagacttaaatatcttgaaatgtcaatgggaaggagtggaaccagaagagaggttggctgaaggaaagggaagaagattaatcaaatgaggaccccaagaagctagaagaggatggaatgcaaagcctctaggagaggactgatgaactttctagagagatatatcacttctttgtaataggagaaaggaaagatgattgtttccttattgttttgtgagaatttaaaataattccctgggataaattttattttctctgtgacaaaggaagtaaaatcatttactacgattttactatgagtgagaagggaggtagtagggttgaagctttgtggatggtagagatcgctgctgtggagatatagagagagctgttaagagaaacacagaattaataagaaactttgagagcctgcttgaagttggacaccacaaatttaagggggatcaatctatgcttccatgattagcatataggtcacacttaaaaccatgaaaatgaatgaatttggccaggaaaagttgattaggtgaggaaaaggacatagatatagattagatagagataatatatattattaactttttacctgtcacgtgttgtgatattttccccccagtttgtcttttgtctttattttctgtatggcttctggtttttctggcttgtgaaaggtctccccctcctcaaactttcttttcatattttcggtggttttattttttatattttaagtctttaatgtacctggaatttgttttagaatatgagattttgaaatgtattttagggcatgtagttgtgtttcctttcagatagataactattatgctaagcccatttattaaaagaacagtccttttcctgttgagtggatatgctaccattgccatatattggatttccatatgtacttgcttctattctagactctattctgttccattgatttaattttccattcttacgccaataccttactattttgattatactgactttttggtaatatctgatatttccttactattcttagatatttgtttctccatatttttacatatttgtgtctccatatgaacttttaaataattttgtatagttacaaaatatactcagtttggattgtgattatcactatattacagttgtgtattagtttttagaagaaagacattcctatgatatgtcttcctatccagaatcacggtatatctttgcattttttcaggttttatttttgggaccgtctctttaatatttagttgttttcttcaaataggtacagtacatttttttgttgttgttgattcctaagtactttgtactcttgtccgtgctgtgaatgggttacttttctatttccatttttaaaagcatatggagaaaagcttttgattttatatattttcttgtgtattacaatcttaccatattggcaaccttatatttaaaaaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctccttctatttactttcatttttttgtccttttccagtttcttaaattgagtgaattcctgtattttccatttttatatattttcctgagtagaggtttaactgtatcccgtatattttggtatttagtgtgtgctctttcattattttctataaaattaacaactttagtttcattttcctctttgattacaaggttatttaggagtattcaagcagaaaatttccctgacccctttgctggcaggaactggagtgcacgggtgctagaactagtcagccacttcagtgccagcaggggcagactccacttgcttggccccaccgtgttccacgccttgcaggagggggagcgcaggtgagcaggtgaaggagctggggcaagcgcttttgggtgctggcaggagcgaaactgtgcttccccacagcagcatctaggggggtgtccatatctcctgaagctccagaaagagtgttacagtcagtgctcttttagctttgctgtccatgaatggcttaagtgttaacagctcagtggagggtcagtgtgacggccttttgcacttgcacttgagttcttgttcaacatccaagaggaatgaggtcgcatgaacaaattggagatggtcaatgtgggggattttattgccaatgaaagtggctctcagcaggaaggggagctggaaaggggacagagcaggatgatcattttcccccagagtctagctgtccccagctggactcctcttcgaagcaacaccgtaaagccgtccctctgaagtcaagctgcttctttccaacttccaaccatagtccccaatgtccagctgcttctcctcttctctctgctggtgaaccctggggtttttatgggcacaggatggggagcagggtggggtatgggtggttttggaaaaggcagctttcaagcgggaaaataggaatgcgtgttctcactttgggacacggttccaggcttgagggcaagacctttgccagagacctatcctcttctgcccagaatttccctgcctcctgcccctgtcatttccctcctctgaagaggctcatctaactgctggtgtaatatggacgatgactggtcttagctacttcctgtttacagggggtgtgagtatgggaagaacagcagtcagattcctccccaaggtctacctaagggtccccagcaaaagggagccattgtctgaggttctggttgcctgactgtttggagtttgatggcctctaggtgcaaagaaacaagttttacagggttaagtatgcatggaccaaatatatgtccaaagaggagttaaaaggagagaatctaatgctgaagattacagaaataagaagtgaaatatactaatcattctgaaatcaacattataccccatggtatagcacagaatggaggtaaaaacaacaagcctaggcaagactataaagaggatatccatggaaggttaattattaacacttatcttttgtgatttttagcttgagttccccaatctcttcacataggtactttgggtgctcttctgggttgatgcaggtaactctgtcagcttcccaggcctttactcgggtatagtgaatacaatgatctattccagtgactttcagtgccataagagtagaaagaagtataatccctcccaatctgggcttatagagggagaaagggaagcaagtacctttaccagtattaggtccactgggttgaatagaggtggccctagttcctgggattggacctccaacagttgtttcagttcctgttggaaatgggccaaagaagttatatgtttaatcaaatcagaggatttttggtctagcaagaaatcattcgtgagaaaaggccatccatacatcatttcaaaggaactcaaacccagctttggaggggtgtttctaacatgtagtagggctatggggagaagggtagttcaggggcgacgagtctcctaagacagcttcctgaggtgcattttgataatattcatcttttctacctttcctgaggattgtggtctccaagcacaatgaagatggtactgtatgcctagtgcctttgagaccccctgggtgacggctgccttgaacaggggccattatcactctggaggtacttagggagtccaaagcaaggaattatctcattaattagtacttttatcacctcagagactttctccgtctgacaaggaattgcttctacttagttagtgaaggtatctatccacactaggagatactggatgcctcttgcctttggcatatgggtgaaatccactgctagtcttcccctggatagcctcctgtcctttggattcctgggggaagaagctgtcgattaaggggattattttaaaggcaggtctagcaagcattaacgatctgtttaactgtatcaggtttttacctgagagcaatttctgggccaactgatgggttttatccttacgtaggtggaaagcttggtgaaggattttaagaactttccattggtcagcagcctgtagatgaagcttgctgtcctccaattgtagccatcctggggactgaaagatgtatccctgagagattgcccattctatttccacaggagaatatttagattatatttctcttaaggggccctctcagatcagtgaggcttcaagtggatcagaaatctgaggctttgttgctgctgatttagctgcttggtctgccaatctattttgcttggctacttcatccatacctttttggtggcctttacaatgtattactgccacttcacatgtgagaaaaaccgaggataatagtctattaatttcctgatggtatttaatgggactcccattacctgtgaggaagtttctcgctttccagatagtggcatgggcacagaggactaggaaagcatacttagaatcagtgcaaatgttaactgtttttcctttgcttaatttgagtgcccttgtgagggcaattagtttggctaattaagcacttgtccctgagtagagagacacactctcaacaatatcattcagagtaactattgcataccttgccttatgtatcccttgttctacaaaagaacttctgtctgtaaagagaatccagtttgggttctctaagagggtttccttgagatcctctctggtcacataggtctgtactactagctgttcacagtcatgttcaagcttcccagcttcctctgggaggaaggtggctggatttagggagggacaggttcttaattggacttcagatccctctaatagcagaacttgatacacgaggaggcagttgtctgttagccagagattccccttagaagacagcagtcctgacacattatgtggagtgcaaacagttaagttattccccatggttaacttagtagcctttggtaccagcaaggctactgctgcatctgcctggaggcaggctgtccatcttttggctaccaaatcaagctccttacttaggtagcctacaggctgctgggctggaccagggcttgtgttagcactcccagggccatttgctttgcttctgacacataaagattaaacatcttccctatggggagactaagggctggtgccttaagcaaggtttgctttagttggtcagaggcttttctagtcccaggttcccaaattagagagtgagttttagctgcctgagtatcctttattaggtgatataagggacaaactatttcaccatacccaagtatccatagtctgaagaatcctgtaatacctaagaatcccctcagttgcttgagggttttggggaggggaaaggaggagatggacttaatcctttctttgcccagtgctctggtcccctctgacaagatcagaccaaggtacttcactgaagtctgacagagctgagctttagattttgaaaccttatatcctctattagccagaaaattgagaagagccttactaccctccgagaggtttcctcagttcgagcacagaggagaatgtcatctatatattgtaaaactttaacctgaggataaaggaactcagagaagtctcttgacaatgcctgcccaaacaagtgagggctgtctcagaatccctgaggtaacactgtccaggttaactgggtagtttggttagagggatcctcaaatgcaaacaaatactgggagtcagagtgtaatggtatgcagaagaaggcatcctttaggtccaggactgtgaactgtttagttccttcaggtacttgagatagcagggtatacagattggaaaccactgggtgtaatggaaccacagcttcattaacaaggtggaggtcctgaactagtcttcattccccattgggtttttgtactcccaatatcggagtattacaagggctgttgcagggtttgaggaggccctgcaaccttgttatcaatgatggcttctagtcctttcctaacttctggtttcaggggatattgtttctgattaggaaatgaggtgggatccttaaggtgaacctggactggtatggcatttgtggattggccaattttcccttgaattgcccaaacttctgtgttaatatcagtcttcactagggggagacaaatagtttgttcagaggccaccagaatggtggtccccatactggccagaatataccggttcagcagaggagttgggctctcaggtataattagaaaggcatgggtgaacaacaagtctccccagctacaactaaagagttggaaaaaataccggattaagagcctttctgagatacccctctcatttgtgctaagagaagagaaggggcccggattggagaggagagctgagagaccaaccccagtgtccaaaaggaggtccactttcctccctttgattttcagaactacctggggctcctggatggtaatggtggtctggaccactggagctacagagaggagccctgggacccatcagtcctgctgaaccatttgggagattggctctggacctggtgaccagcctccctggggacagtctgccttccagtggtccccactacagattggacagggtcaaggtggcttcctcatgctgccttggcaatcctttctaaaatgtcctggcatactatatctgtagcagttaacaggtgcacctcaggaatcctggggtttgtgggctttcatggtggccattaaaccctctgcttctttcctatgttttctctctctctcctggacctccctatctctattataaaagatcaaggtggccactttcaggagattcactaaagtactatctggtcccagggtctgtttctgcagtttcctcctaatatcaggggctacctgagtaataaatttatcctttaggattagttgtcccttgactgaattgggagatagagaggtgtgctttaccaaggcccctcttagcctctccagaaaggcagtaggattctcatcaaatccctggtctgtcacgggtagcttcgtataactgagaggcttagttctggtcctacgtaagccctccatcatggacacctaaagtgtctcctcttccactctcccatctcaatattgggatcctatttagggtcatccaatggtactgcttcccttccaattggataaagtttgactccttccctgacaatatatgtgatactaagctcatccccaaatccctctgtcagctgcagaatggcgtgcttctcagtgttagggtttgattcaaaagtaacataatgtctttccaggagagttcagatacttgggttatattctggaaagcctctatacaactgtcagggtcatctgaaaacttgccgtgatcccccttaatctgccttaagtcctgtagagagaagggcacctggaccttactggggtcaaattcaccaggcatctgttggagaggcaggagtgagactggggcttgtccagggtgaagatttctaggagggggcaagtgagagagagaagctggatggggaggaaggggtggacccagaggagcagcgctggagggagctggctgtcctgctggaggtgtctctggggttcatttctttagttccttgggattgccacttgcagccttccctgagatggcaaaccggagggctgaaccaatcctacactatcagcaaaggtctggattacttgcaaggaaaagaaagtctgcatgtatggcctcagaccatctgtcctcatgtttacagaaaaggtccaactacacgatggtattgaaatgaatggttccttcctgaggccaagacagtccttcctgcagatcacaatttggctaaacctttgtgctatgaggcattttacctccagagtatgagggtcaaagcagttccagtgattcaggataccctccagaggagtacagactggggtggtgaagatagctggttacccattccgaaagacagggaaataggtgtctctcatttcacttccttctttcagtgaaaacttgaggtatgagggagagagaaagtgaacctcctccttttctcttccatcattttatccccaagacttggcaaccttagatggatgccacccacaggtgccattgcagcctgcactcataaaacaaggagggcctagagaataggaattgtctgcactcacctatgccttcatcccctttactgccggcaacctttgggttcccagggctttatctatgccgtggagcatggcctccttccatgaagcagaggcttaatcagcaggaatttgtcctacccatttatactgtgcctgttgcctcacttgggattcttcagatctggttttcctttctagggcttcaacccaaagtttaaaattgagtttagggcaaaaaggtgcatcagtgggtgcatggattcatttagattaagtccatgatgggtcctgtcaaacttgcagttatcagccagcggggccactcctccattgctgccctatcataaccagagtgccgaggtaggaaaagaaccctatcacatagaaaaagaaaggaaaaaaaaaaaacagctgaagagagggggaagaaccccttgctctatgcaaatgggttcctttaatcactgtattcttcccccgctttggactgagctgaactcctcagccagaggagtaaaggctctatgggcgtgtgatgggaggggacggtgagtgggaaatgctggacagctgcccgtgtggggtccctgggccccaagactgccctggggccctggctgcagctgtgattttctcctgccctccatggctgttggaagtggcacatgcatgctttggacatgcccaagtgccccagccaggaggggaggggatggagaggaaactcactgcgtgccatgcatgtctgcagctgttggggtgggggtggggatggcacctctaagaacaaacggaaatcacattgttctgaattgcatatctgattgctgggccaaatgttcattctacttaataacatttctgcagtttgcagcaaaactcttaacattataaaagaagcaataggagccatttcaaaccatagaagaagaaaggaaagataccacagaaaaatctgagcatcttggcggaccacctattacattggggatggggtccagttcaggggccttctggcaacaacgaggagtggcattggccagatgccttcagctgccccaggactttattctggtcccacatgatggctagacccatgtgaagggaagcagagccttttacccaaaagagaaatggcagggttgcatcctgccccctgcaagtggcatagatcagaggaaagtctgaggacaagaaaagacagatccacatttttgcatttactcacccttctgacgtatcccagacaaggccctaaaatggagcaggaaatttccctgacccctttgcaggcaggaactcgagtgcaggggtgctagaactagctggctgcttcagtgctggcagggatggactccacttgcttggtcccactgccttccacccatcacaggacggggagtgcaggtgagcaggtgcaggaaccagggcgagtgcttttgggtgctggcaggagcaaaacttcatgtggatctgcagcagcatctggcgggggtggggccatgacccctgaagccccagaaagagtgttacaatcagtgctctttcagctttgccatccacatatggcttaagtgttaacagctcagtggagggtcacggtgactgccttttgcacccacacccgagttcttgtccagtgtccaggaggaatgaggtcacatgaacaaattggagatggtaaacttgggggattttattgccaatgaaagtggctctcagcgggaaggggagctgaaaaggggacggagcaggaagatagtcttcccctgtagtccagccatccccgaccagactcctctccaaagcaatgctgtcaagctgtccttctgaagtcaagctgactctctccaacattcaaccatagtctctgatgtccagctgcttctcctcttctcttctctctgctggcggagcctaggttttttatgggcacagggtggtgggcagggtgggccatgggtggttttggaaaaggcagcattcaagagggaaaacaggaatggatgttctcactttgggccacagttccaggcttgagggtgggacgcttgccggggacccactctcttctgcccagaatttccctgcctcctatccctatcagtatgtttcttaattttcaagtggttaaggatttgggaatttatctttttgttattttattcttattttacaggatagtgatcagagatggtaaactataaactttttcttcatgatcaattttaaatgctccatgaatataagggaagaatgtattattctgtatgatgcaaagtttacatgtaactattatattgatgtattgatggtttttttctatagtcttatttttgtttaaaacttgttttgttagtttcacactaaaactataactgtccagtgggttcctcttgtctgctgcccagatagagctgacttatcaagcagaagaattggcaatacagagaatttaattgacatgaggtgggccatgcctctcagaatttggggactagggtttttctttctttttcttttttcttttctttttttgagacagggtctggctctgtcacccaggctggagtgcagtgacatgatctcaactcactgcaaccttgacctccctgcaacctcagactcccgagtagctgggactacagacacatgctgccatgcctggctaatttttaaatattttgtagagacaggatttcaccatgttgccaaggctggtctcgaattcctaggctcaagcgatctgcccacttcagcctcccaaagtgctgagattactagaatgagtcactgtgcctagcttagggttttccaaaggtagtttgggggaaggggtgggagtggttagtcattgccattgggaagtggttctcttgcatgctgagtcgcttctgggtcggagcacatgagtgattggcaggtacaggtggagccattcatggtcagatctacaaaaaaacctgaaaaggtatctcaaaaggccaatcttaggttctacaatagtgatgttatctgcaggagtaactggggaaattgcatattttgtgaactctggaataatggcaggtaatcatttatgtctacatcttagcagaattcaggcttttctatgctttgagcctggtggtctctcattagctttacaaagatggtcgagttttggggaagggttcttatcatttaaactataaactaagcgtctcctaaaattagcttggcctaagcccaggaataattaagggcagcttgaaggccaaaggctagatccaatttccatcactgacatcgttttctcactgttataagttttgcaaaggcgatttcaaaattgtatcttttttctatcttatccctttctatttttaaggatatttatttcctagaagtggaattgacagtttaaagtaaagccacgtttcaatgtattgacacatattgtcaacagtctctatttgccaaggcaatttatactcccaccagaaatgtacaagggggcagattttcctttaccatgctgttagagtgctactaaattcagtcacctacacttagcctttttggtcatctctcagagaaagattgttggatgctgggcagtagtagagagcaggagctcccactgggttagggttaggtctgacaaaattggtgaaggtcatccagtgggcatagtacccctgttacaaataagactgttgaacttttgaggtttgggttgcttcaatacagaaagaggtcacagaaatcagaagcagttttgattaagcagttaaatgtccccatgttcgacttaagtagttccctccacactttctgccatccctgcatcctctagatttctcactctctttgttctgcccagtgatgaccttttcttctctctggtgtgtccttcaaaacttgttttctgagatactgaaattcacaatgacatatgaatgaacagaaaccactgtacagggatctgccttttcataaaggacatacgttcctgaaagtagaattttaagcatggatggggtgtatagtaccaatgaggtcttctatttcttcactaggaaacagcactcattaattattcattagaaatatacatggtatttgaaaaaccagtattaaattcctcttcataaaatacctgattcaaacaaatcaactgtaaaagtacacttttttatgtaatcaggacaatttaagtatagaacaagcattagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagaggtaccagaccagcgtagcaacttggagttggagaggagtaggcatggaaatcaatatttatttaattcctactatgttccaggtagtgtgctaagacctttgtctctgttatctcatttgattctcataaccacttgtgaggtaggtaacattgtttctattttaccagtcagaaagatagctcagagatgttaagtgacttgtcatgaagtcacttggctttcaagcgtcaaagcaggaatgcagattcaggccagcctggcttacaatccagactttttcccactctactctgctgcctgagtagaaatggaaacttagcacaggaaaatcctcaaaaaaagggaaaggtggttttcctcaaaaataaaaataaaaataaattttagctacaaagagaccaaaaacaaaacaaaacaaaacaaaaacagggcagattagaatggaacatggcagaagtcttggccttggagttaggatgcccagtttggttgtaactctgtcatttgctagcttatatgactttgataatttactttacctctctagatctcagtttcctcatccataaaatgcagacagtagtgtctaccctatctaatcaggttgttgtgaagatcaaatatagagatcaaatatatctgaaagcactttctaggccaagccataacaactacacagctgtaataactatacaaccataactaattatttcttttactagcagtaacaatgtattaagatggccagatttttggaatttcccagcaggttgagatcccttcccgtttttgtttttgttttttttccaggagaatctcttatttatttatttatttatttatttattttattatacttttaagttttagggtacatgtgcacaacgtgcaggtttgttacatatgtatacatgtgctgtgttggtgtgctgcacccattaactcgtcatttacattaggtatatctcctaatgctatccctctcccctccccccaccccacaacaggccccggtgtgtgatgtttcccttcctgtgtccatgtgttctcactgttcagttcccacctatgagtgagaacatgcggtgtttggttttttgtctttgcgatagtttgctgagaatgatggtttccagcttcatccatgtccctaaaaaggacatgaactcatcattttttatggctacatagtattccgtggtgtatatgtgccacatttttttgatccagtctattattgttggacatttgggttagttccaagtctttgctattgtgaatagtgccacaataaacatacgtgtgctcgtgtctttatagcagcatgttttgtaatcctttgggtatatacccagtaatgggatggctgggacaaatggtatttctagttctagatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcccagctgctttgtttacctactcaagcctcggcaatggtgggtgcccctcccccagccttgctgccaccttgcagtttgatctcagagtgctgtgctagcaattagcgaggctctgtgggattaggtccctctgagccaggcgcaggatataatctggtgtgccgtttgctaagaccattggaaaagcacagtgttagggtgggagtgacccagttttccaggtgctgtctctcacccgtttctttgactaggaaagggaattccctgaccccttgagcttcctgggtgaggcgatgcctcaccctgcttcggctcacgctcggtgcgctgcacccactgtcctgcaccctctttctgagactccccagtgagatgaacccagtacctcagttggaaatgcagaaatcacccgtcttctgcgtcacacacgctgggagctgtagactggagctgttcctattcggccatcttggctccatcctcctgtttgttttatacctttttttttttttttttttgagaaagagtctcaccttgtcacccaggctggaatgcagtggcgcaatctcagctcattgcaacctccgcctctcaggttcaagtgattctcctgcctcagactcccgagtagctgagattacaggcatgcgccaccatgcctggctattttttgtatttttaataaagatagggtttcaccatgttggtcaggctgagcctaaaacagacctcaagtgatctgcccgccttagcctcccaaagtgctgggattacaggtgtgaaccactgcgcccagcccatcctaatcagggcctctgacccccttggggttttccccgtagaaacccctttgtttatttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctatcctttttttttttatacccagcacatggcttggtacacgaataggtaccgagaaaggatatttggataaacattgccatctggtggccagatgttgtaagtacaatcttttatgcatcataagggtgagtaaagcccaggtgagtaaagcacctaggaaaggcaactttttatttattttaacacagggaaaggaaatatttcagaatatgtggtctcctagaatctcctaggtctcctagaggtgttgttattccaacgtctctccaaatctttcataattcagaaaacaatatttaaatgacacaacagataaaactattttgagtgtgcaaaaataaaatgaaagagaaatttgtctcatgtaataaagaaatgtaacatagtatacaataccttttttcataatacctttatttcaatgcctacacacattcattcattcaacaaatatttactgagcatttactgtgtgacaagcactattctaggtgttagggatacagtgaacaaaaagtgcttaaacttaaggagcttacattctaatgggaggagacacacaataaacaaacatatttttattagggattataagtattacggataaaaataaactaggttacagagtggggtgagtgtgtgtgtgtgtgtgtgtgtgtgtgtgtgtgtgtgaaagagagagagagagagagaacgccagttgagcaaaggcctgaagatatattagaacttcagaaaactacagaaatgttggttgaccaggcctgcctaaaacattatgggacttctagagagttttctttcttttttctttttaaaaataagtttaatcttacataaaagttgctaaaataatacagagagttcccacatacatttaactaaccttctctaatgttaacatcttacataaccacacaactatcagaactaggaaactgtcattggtacaataattctattgagcaaactatagacctcatttgatttttaccagcttttgcatgcactcaactttttttggggggggggtggatagttctattaatcttatcacatttatagattcttgtaatcaccactgtaattaggacattattgttttatcatccccccaaaactcatttgtgctacttctttataggcacatctgtcccccagcaaccactgatatgttcatcattactataattttctcatttctagaatgttatgtaaatggaatcatatagtatgtaaaatactgtgatttgctatgtcactcatcataatggccctgagagccactgaatttgttgtgtacatcaatagttttttattttttattactaagtagtattctactatgtgaatattctacaatttgtttatatgtgcccacggtgaagagcatttcagttgtttccagttttttgctaatagaaacaaagctgttatgaccattcgtgtaaggtttttgtgtggacataaatgttcatatttctagggtaaatacacaaggatgagagctagagagttttatttcttcagagggatttataagcaagtgccatgctttacaaaacaagcagtagattggaaagaacactggataggactcagaagatctggctcaagccttgccctgtcatttagtagcaatgtgatgctggataagcctctcccctctctaggccccatatttctgtctcttaagtgatggagtaggaatcgattatttcttcagtctttttaagatctaattacatggttctgacgagatagaaaggaggtttctgcctcatttcacaaaaaattttatagctatgtacataaaataccagatgaaaaacataggttatatctcccacctttttcttccatgttccaaacagttacttggtggcttacacctgtaatcctagcactttaggaggccgaaggtggatggatcgcttgaggtcaggtgttcgagaccagcctggccaacatgatgaaacccatctctactaaaaatacaaaaattagccgggaatggtggcgcatgcctatagtcccagctactcggcggggttgggggggtttgggggctgaggctggagaatcacttgaacttgggaggtggaggttgaattgagccgagatcatgccactgcactccagcctggacaacagagcaagactccgtctaaaaaaataaaaaataaacagttactttgcttacaaagagaatatgggggagacagtaactaagcctaaggctataaaggtttggttgtctgttccctgaggagaaaggactccaaaatcaacacagaatggccacatggcataatgccattcctaaggcatgtatatgaagcagattgtcctcacgctctgtctccattatttttattagttagacatagagtaaagtacatacaaaatatatgtgtgtatatatatgtgtgtgaactgtctatgcttttaaaatatgttgtattatgcatttctatacaggtactattttttttcaaaagtcaggaaggaaatacacaaaatatttgcaatggttaactctagagattgtgattgtcgtgagaggcaactctaaaggaaaaagaagtatatgtttgtgagcacagcctctctctctctcacacacacacacacacacgcacgcatacacacagtggttaaaaccatagacatgagccagactgcctgggtgcaaatcctggctctgatatttactagttatatgaccttgggcaagttacataacctctatgttttctcggtttcttctatagaatgggaatggtaataatagtacctaccttatggggttaatgggaaaagtaaacaagtgaaaatacatgaagcaattagaatagtgcctaacatgtggttagcactataaaagtattaactcttatgtactcctcccacaagcagatagaaaacttttctgtcagtcattgtctatctgaaggcctcacgtagcatgagtccctgagcccaattcactacgatagttatacttctagaaatggcttggctgccacctccccatccacactacttttctaactttaacagccaatctcccagctacctctactctcctaatccctcaccccttccctggccaaaaaaattacacactgaagctgtagattccttaactatgtctcagtattttttttgcttgctaaactgtagttactccagtacaggtgactaaaaattctattaataatttcatttatttcttgctcctttaagtgaccaccctccctcaaatctaaagaaacaggtataaccaattttttttaaatccctgcttcatttagtcatacttacgtaaagctggaaggaccatctttgaaatgttgcagtgtttacctttagaaaacaaaaaagaagattgtctcttcttcctcttccttttgtacatttgaaacttcctgatataacagggctatagtgctggtggtgatcatgatgctagtgctagtggtagtgatgtgtgtgtatgtgtgtgcgtgtgagagagtgtgagggtgggaggagagagggagaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatctttgcaacttatggctttggcgaactcccacctatttatttcctagtattgaacagtggtaaagtccttccatcaggggccttatgtgtttgtattaagaataggtggaaattggggaagactaggtcttactctacagtcagtctttgggctgggaggtaatagggtaggatgggcagttggaaagaaatatgcaagtcaaatttttgctgccttaagaagaaagtaaaagagcaaagagcagagaagaggacctggagacttaccagggagcctgtgttgcctagtgtttaggacttggaagattgaggctaagactcttagtcataaacatcacaaactgcctcccaaaagtctttttggggtgggtggatttatacaagtaggttgccaagattgacctaatggtattttcaaggaggatagattttttttccacagacataaagccatttagacaaaaccactaacctaatacaaagagcgaatgtcaaataaagagctagggtcttccacaaaccaaccaaccagccaagtatgcttattaaggtaacccagttattttcaattaagcgttaataagcaagtgaaatacctcaatgtattatgtcttcaaacaaagaaaataccaggggctttcaaatgtcttccaagcaatttgagttgttttattcacatcacaaagaccggttttccctgaagtatttcctgttcagaaaacacttaaggaccctgctcttctggggtgcttcttgacatgaaaagattttaatgtcattgctttacctttagtttggaattgtgcctcttcagccaacttttcattctattagttgtgcctggttttatctcccctgatgtgactgtccaaaaaacattcccaccctagctccctcatttcaccttatattttctctacaaaatacactcactggagtatattttataatgcttggcattcttattttgatttttttactgtgctaaatcagtcagtaaatgtttgttgtaaggctttgtaccagttataatgggagagacaaagtagtgtaaaatcttccctcaaggagcttgctgtctaattgaagatatgtaagcaaaagagtgcttcttatatttgatatttcctttctattactgatattctccttgggtatgccctgtccacatcacaacagcctcctaaatagtcctcaggtttactattaccctccatcaaatcagtccctgttcatcttcttaaacaagttcactgtggtacttctcgcaccaccttacctttcctcccctcaaaaatactacttaaagataccatattgcctaaaaataaagttcagtctcatttgtttggcttgaaatttctctccttcacacctttttaatctaagtcttattccatctttaagatttaattcaacttccatttcatccatgcatctttccttcacttacccaccaaaagtaatctttccttttaatttcagtagattatagtctacatcacccattcagtatttaatttatgctaccttgattggtttcttttatatgtatatggctcttccccatccagtttgcaaagtttttgagggcagggccttagcataatgctttgcacagaaaagatgcttgataagatgtctggtaatgaagacatgatttttcctggcttcagagtagaggaaggattatgaggatgggtggcaaaggaaatattctggaggtagggagattaattaacgaggtttttgcaacaacagtcctatcacaataggtgataagggcttcaacctattggttccttggctcagatcctcactatattaacgaataagggtagtcaagtgaagcagtgggaatggagaaggaacaaagaaacctgtaactatttgcgatcagttggttgtaaacactactgcacttggaccagccactgaggaaatttagcatgattaaaaaggaaaggagggaaggactttgggactgctgtgaatttatgtggggacaaaggagaagtagcagtcagagtttactgaacctgagtaactgcaataatgatagtagcattgacacaaaaataggaaaatcagaggtggaagccagatctggagagaaggtgataagtttgtttttagacttactgagtttagggtaacttgagtaacaaagtggacatgtctaatgaggagtaaaagataccttttttcacatttaattcaatccaacaaataattacggagcatctactatgtgcccatcatgatagtggagctagatatagtcacataagacacaattcttgccctccagaactcatgatggagtgaggaagacagactaatatgataaaatataggaaatggtataattgaactatatatagagtatgtgaaaatataaataggggatcaattgcttgtgtccaagcaagtgagaaaaatcatagaagtgatgatctttgagaagggccttaaaagataagtagaaatgtgttcagtaaacagatggggaaatgactttccaagtaaaatgacaatctcgggcaaaggcacaggacatgaaagtgcatggcattctaggggaacaacaaggagtctgaagtgactaatgagaaacggatgacagaataaagatggatgatttgaaagagatgatgattttcagaaattgaagaaaagggtgttgttacactcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtggtgcttcaatgcccttgcatcattaatatcatcatctctacccttcttctaggagtggatcttatgagggaggtatggaagaagttgtgcatgcttagctgtcagtccgaaccttttagagccagcaggggacaaaggcaacaatcactgtgtaatactctgaaatttcttggcaggtgaatactgctatgcatgaggcaaaacttatggaagaatgtgacgagttggtagagatcatccagcagaggaagcaaatgatcgctgtcaaaatcaaagagacaaaggtaaagcgcagcacttcagtgaatccaaggaagggttgactttacaaatatcaaagtttgatccagatgattctggtttgatcatgaaatcaagaagaaatgagattatagggggagaggcaaagaagtgatgtttggcctactgctctgaatccagtaaaaacgatggccattctggggtgttagaaacgttctatatcttgacctggtttacgtgggtgtatgtgtaggcaaaagttcattgagctgtacacttaggatttgggtgctttactgttgtatgttataactcaatgaaaaggaaaaaagtaatggtagaaatgtgagtcaggattatggaccatgaattccaggatgaggactctgggcttaatctgaaaagtgttgggcagccattctcgtttcttaggaagggagaaagacggattgatatggcagaggtatgcagggtagatcagaatgggatgataccaaagtcagggtagcaagttatgagacttatggaatgatgctttgtaagagttgataaagacctaaaccagagtagtggcagcacaaatgggagggaagaacacaacaggcactgctagaaaggaaacgataggaaacattgaacttttaaatataaaagacgaatgagagagagggaagactcagtgaagacattcaggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattatcaatagagttcttactttgtactgggcattattttaagccttcataagtattaactcacttaatcctcaaaaaaactttatgaggtagatactacttttatccccattttataaatgagagaacgatgttcagagaggttaaataacttgcttacaattgtccaactagtaaggggcacaggcaagattcaaatttagggagtctagtgccacagtctacacttttacaacaaagccaagcaatttcagctctatcagatgtttttattggcatgaccttacatttctaaataacatccttacattggtagttttaatttttttcaactttagacagtatcaattaacttctgcaaatttggactttttttctgccactacttctacaaatatttttatgccacttccttcctctctattcgggattccaattacatgtatatttggctgtctgaaattgtcctatagcttaccaatgctctatttttgttttgcagtctttttatttttttgccattgtgaaaacacatgcaagtgtgtttcattttggatagcttctattgatatatcttcaagttcactagccttttcttctgtgatacctaatctgctgttaacccctccagtgtattttttatcttagatattataactttcatctctagtttgatttgggtcttttaaaaaatgtcttccatatctcaagatattcaggctgggtgtggtggctcacacctttaatcacagcactctgggaggctgaggtgggaagatcacttgagaccagcctgggcaacatagcgagattccatctaaaaaaaaaaaaaaaaaagcctgcatctggtgacatgtgcctgtagtcctagctacttgggaggctgaagcaagaggatcttctgagcccaggagttcaagggtacagtgggtcacgatgctgccactgcactccagcctgggcaacaggacaatgtcttgtctctgaaaacaaaaaaagatatttagcctttcctctagctttctgaacatatggaatacagttaaaataattgcttttatgtccttgcttgctaattctaatacctgtgtcatatctgggtccgtttcaattggttgccttttcttctcattatggattgtattttcttgattttttgcctatcaggtaattttttactggatatcagacttgttaattttctctttcgggatgctgtatatttttgtattcctataaatattcttaaactttgttctgagacacagttaagttacttgaaaacagcttgatcctttcaagtcttggttttcagatttgataggtgagatcagagcaatgtttagtctagagacaatttttctccactactgaggcaaaacccttctgagtactctattccagtgtcctgtgagtcatgagattttccagtttagctggtaggaacacacactattgctagacctatgtgagtaccagggattgttccctcttatctttttgggtggctctttccccagcattatgcagtttcctcgcatgcatttgttgatcagtattctgttgactactagagggaaactctgaaggtctctagaattctctctgcagctttttcctctctggtactatgtcctgtgaactccagccaacttcgtccacttggattctcagctctgtctccttaattttagggaactcattgggctctgcctggatttccccttcctgtaccacttgattcccttaagcttttcaaacaaacgctcctgtagtttcttaagaaagagtacatgggaagtaaattttcaagaactttttgcctaaaaatatttcaagttaattttcacacttgataggttggaaataaattttgaaggcatgacttcattgtctcctggcttccattattgtgttgagacgttcactgccgttttgaatccagatcttttgaatataacctatgttttaaaatccagaagcttaaacaaaagttaatattacttttaattgacaaatcatagttgtatacattaatgggttgcaatgtgatgttttcatatatgcatacaatgtggaatgactaatcaaagccaattaacatatccattacctcaccattttttgtggtcagccattgagatttactcttttagctattttgaaacatacaatatgttattattgattatattcacactgctgcacaacagatctcagaaacttattcctcctgtctaactgaaactttataccctttgtccaacaactccccattccctcctcataccagcctctagtaaccaccattctactctctatttctatgagtttgattttttcagattccacctatgtgcgagatcatatggtatttgtctttctgtgcctggcttattttacttagcatacatcctccaggttcatttatgctgtcaaggataacaggatttcctccaacttcagtggctgaaaggtattacattatgtatctataccacattttctttatccattcatccattgatagaaacttaggtagataccatatcttggctattctgaataatgcttcagtgaacatgggaatgcagatatttctttgacatattgatttcaacttctttggatatatactgactagtgggattgctggatcctacagtagttctatttttagttttttgaggaacctccatactgttttttataatggctgtactaatttatattcccaccaacaatgtataagggttcccttttctctacatcctcaccagcacttatccttcctccttttaataatagccattacgatctagaagttttaaagatcttatctttaacccagtttttctgaaatttcatcaagatttgcctctgttatagattttcctttcctttcctttcctttcctttcctttcctttcctttcctttcctttcctttcctttcctttccctctctctttctccctctctctctctttccttctttctttcttcttgttctgttgcccaggctggagtgcagtggcacgatctcagctcactgcaatctctgcctcccagattcaagtgattcttctgcctcagcctccctggtagctgggactacaggctcacgccattacgcccggctaattttggtatttttagtagagatgtggtttcaccatgttggccagggtggtctcgaactcctgatctccagtgatctgcccaccttggcctcccaaagtgctgagattacaggtgtgagccaccgtgtctggcgcgttgtggactttttgtcattcatttttcctgggcactcagtgaatctttctaatctaaagactggtgacctctagctctgggaaatgttcttgtattatttgctaataatttcctcccctttattctttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagagatatgcctttccccttacaaatgacaccttatattatgtgcaatagaaaccaaggccttgagagactgcaacaagatcgctaatgttgtgttttgcttaaataaaaaaacacagacagtcagatacacacacacacacaccccaccatgtcacttttaacccattcttaacctttggtccatcattaacatttaggaatatggtattctaatatttctatttagatatatttcacaaacatgatatgctatatatactatattatactctacatttgaaacaatgtatcacaaacttttctctatatcattggatattataaaacctgatttccaattgcttcatgttattttatcttttgatgtatagtacattacttaactcagtctccactgttagacaatcaggctacatatggtgtgttgagtgcccttgtagttctatctttgcatacatctcaattatttccataataaaaattttatgaaatagaactgtggtgtcaaagaagacttatattttaagctattttgaaatttaatgctaatttggccttcaaaatatgtatcaatttcaatcctaatacaaatatgtaggcattattgactataggcataaaagctcctatgctgtcatttgtttgtaatttaaacgctatctcattttaatttacatttctttgatttctcataaagttggactttttaaatatatttattggccatttgtttgctttgactttgttttctttgatgctttgtgaattaaccctttttgttttgtttgtttacactcatgcttattccaagacactttaaaatctggtctctttgcctccaattttgaccctttccaatccctccactgaagccatagtagtattcctgaaacatgaatttcagcatattatttccccacctaatgcttagtgacccccatcgttcttaagataaaatccaacgtttgtaacgtggcctacaaagtcctgcatgattttgtctcattctccaggcttcaaacaagagagaacacacacacatccacatagtctttgcttagttaactcttactcattacataggtcattggtgaaaatcgacttccacatgggagatttcccttagctcccaagtctctttagataactcctgtgtatgctctactccctttgtagcagcacttctattgcccacgtaatgtctttctccttcatgatgtgtgagctcttgaaggcaagaaccacagcaaagcttgttcactttgtgtatctccagtgcccagtacagtgcctggcacattagttgtgcttaataagtattggatagatggatggaggaaataaagaagattggagaggccagaaagaaattccatgagctaattttctagattaactgttatcctaaagaagttgttgtctccttactcaccaaatcctggctattcatgtgagaccttatgattgtactgagctagtctttcatttggcctgtagtttatcactgaaacatctctattttcagaaacaataagaggtgttgttggtagatgtatagcagggtatatgtacatgaggatatgtatttttcagtttcccattcccttacaactagttcaccataaaagtttcctctctggtcttcctacattcaatgccttttctctctcctctaacctacatattattgccaagtgaatttttctttcctcaccatcatttacatgttcaaggatctcattggctctgatttagaagatcttgcacaggactaaaacatgtatattttggcaaaagctcctccagataatcctgatgtgtagcgatggctaaaaattgctgaaatatataaaatatacctcaattttttgaagaaaagaacagtctaaatggttaaggttatagaatttagaatcagatggacatgggctcaattatatttctgactcttactggttgtgtgatcttggacaagttacttagcattttaatgtgccaactttctcattcgcaaaatggaaataacatctactacatagtgttatggtaaagagtaaattagatagtgtatgtaaagtgaatgcacagagcattgtatatactaagcacccaataaatgttagcagttattttgttgttagtcattcaattgttcattcaacaattattttttcactatgtgtcaaatgctgtgttagggccatggaagatattaagaggtacaaaatatgaaccctgctcttgagactcctagatttagttgggaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatactgggctaggagatggaaactgccacattgctctaattgctaactttttaaagctctagtgatatcagcattatgcatctaagtgtaaactatttaaggaataaacatatatcctatttgttatatatcatatatggtgtcttacacaactcagataattcataaatgtttatttctctctcctttccactgtctcacaggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 3599 - DNA, 41383 bp, human
acatcccaggagacaccaggtggggcgtggcacctcccacacacggctggagggactcccaggatttcccgtccttccgaattcgtggggggtcagaggactgcggggaggcgtttctcatcctcgctggggaaaggactcacctggttcccaaagccagtttgctcttcctctacttcctgccagagggtaagggattccaagagaaagacaaggtctttagggcggagaaggggaaatgactcagagaggaggcggcccagagggaggggctgggctggaaagggagggtagtggggtgccggagggaaaggggagaaaaaagaggatgggagaatcgcctcgggggcagttttgggggtgtctagcaaagacctggaaggccttcccggttaaccctgacttcaggagctgctgcactgggtcatttgtttcctcagtgctgggccttaaactttacctcgtacccaaagcagccatggctaagacccttgctagcagctcaccaggcatgtaggaatctgcaggcctgggcatgggcgcatggaatgattaactcttcatgttcgagggagccaataatagtctttacctcataggattcctgggaggattgaatgaatcactgcatctcgagtgcttggcatagtgccaggcacactgtaagcaaccaataaatgatagcgcctataattcaaaaagtcttcattcgttgatactctgtcttctctctagattatgagtctcatgagggcagggattatgtgtcttattcatcactgagctccagcacctgccacaaacagactatcagtaaaatatttgttgaatgagtgaataaatgaatggcggaataataacttggagtggtggctgtaccaggactctctcctttgccttttaagggatgtatctgtgggagtttggattgggaagatcataattggagaaggtggcacacaggacccctgttagttgctgtatcaagtgacctactctgcccttggaaagtagaatatctttggcaattccctgcatgtacacattgaagactctcagatgactgacctgaaatttgaaacagagacgccactagctaaaacagtatttgcattttgtacagttatcaagcaggatgggggagagggctgaagcagaaagctcaaaagtaatggtagcagcggattggcaagggaggtccaagtgaagtgaagtgtgtatggggaaggatagtcaccccaaaagggattctgatgatggtcctaaagtaacagtaatgtcatccacttctctgtcccagtcgtaggatttctgatgatctgccctgatgtcccaacattcttggggtaggtatgcacatcaagctcctatcactaccttcactaaatttgcatttatggtaattcatactgttagggctagaagggaccttagaaattacccatactctttaattcctagttgaaaaactaagtgccagagatggcgaaggacccaggccttggaattctctggccttggtactgaatctttcagagactgaatttattttatatcctaattatgcatttaatctctgccccatccccacccccaactcccaaaatactgagaagaatgaaaggacatgaatggaaggtcagcagaagggaagaagagaagaggtacttcaaaagaccctgactttacttccttttgctttgccctgaggaatttacctggaccttcagctagtctctgcatgagaatggctctaccctggcaccctagtcacctggcaatatctacaatggtccctcgagcaaagacttgaaccacagctaatctgagtcttggtagaatgcctgtgatccttccagagcacaaaggatgggaggcctgagaggagctgcttcaagatcatctcccacttgcctccttatgtcccttggcaagtttcatgagacagattttcatagcctcccacctcccaggttctgatgaggtacaagacttcctgaaccacttccctcagaatagagctacagactataaagccacttaagtgcagtctataattggcttcttagcagtgaggtatcccacaactcacttggaagtcttctggtcctttttgtttcagtgtcatcctttttgttgtttgggacaaggaccatttggggctggaatctttgactgctttttctttcactgtgtaaataataaactgtttgaatttaaaagtgattccttgtatctttacctactaaatcagtcaggccttggacttggacttggacttggacttgccatatgtgcttgacagctgcttactgtgaatttcacatttttggctatctcatgaccctctcttaccactgagggagttaagtcgaacaaagagctgttgaccatagtagctttttcttatcactatacatcaaagggaaaatcagcccaaattccattttctgggacttttaatctgcctggaagagcaacagatcctcttcgtattctgtgtgcaaggccagcccttgtgctctagaaggatcacaggcattgtgctaagtgagactcagttctcatctatatcccctttgaaagagtcctcttggtccaaaatatttcccctggcaggggcttagcctgccagggcattgtcagctgacccttctaaactggaaagtctgatgcttgccctccccaacttgtcagtcccaagtcagacacaaaaacattttccctagaaggttcttgttaacatttcttgttttctgagaaacaatgtcttgttttctgtgtgaattttgcccacattcctccattagcacattattggtggctaatttattaattcttttaattgttccctttgaaggagcctggccttaaagaacaatggaaagaagcagtcataggaatcctggaccaggaatatgtgcctgagagggattatacacctggtgctggtgagttcacccaacttcacaatgtatgaggtggactacttgtcattctgcttatcagattctaattctattcaaccagcatttactaagcacctactatgtacaagtctccatgctagatcttggtaagagcttccacttgcactccagtgtctctataaatgctccctttgtcagctaccactattaactcattgagttcatagatgtaaaactatctgagaagcagtattgaattgggtactccattataaatgttaggaatatttttcatcttaatatcccaccacagaaatgagaagagtactaggaacataactagtggttaagaactgctcttgaatgacccgacgagatcagtcgcaattgtaatttgtgtattgtgcccaacagtataggaaaaccaccttgatcctccattcctggaaattcatggtggaggagagtcattctcattagctgtcatgctatatacatttctaataagcttgtaacaacctatttggtctctgttactcctaaccatcataactgagaccacctccctcccaaatacaggctcagattcactgaaactctgggaccaattctattctcagatggggaaacataaagaatcccatatctgccctgtcctcgcacattaaatggagatggcctttccaaacatcatcacacacacacacacaaaatattaaaattttagctatgggtaatagcctcatatttggtatttgcctaggttgttcttcaattaaaccactaaacacacaatgttccaaattcttttctcctttgaattttactccttttacctttgggctgtagttcttataggcccctggtctgatgacctgtttcaagtcacttctctagctgccgcccttgactgccctgcttcattcacttcatatcgcatgatcccttttagtcttagtgccactacaaatctgattaagatatgcccaattctagccctgagggacctcctggcttcctcccagtctcctcctgcaggccagctgttttaacagtaagtcagctcacttgcttctggtgctaccctaatcttaatcaatgggttccagcactgggattttatttgttctttaattctcaacttctgctccaatctctaaaactgaatgtgtcatgtttccttgaaccctatatcttcatttctttggtcttcttgaccatatcatgctcctgaaatcaaagtcttcttgattggattttgagctccagaccccctgggtcctttctgtccagatcactacctattatatgatccttggtttcccctagtcacttacccaattccaggagaatccacggccatcttccttttagtcctcccccaattcaactccagcgagagacaacaaagaattcatgaatacatatatatttatttaattcataatatagcattttggatgggctggaatattgtagagagggatgaggctgtgtaatccacagatgctcatatttctgtcactaggagagacactattggtccagagctcccaatacaaacaggcgtggggtaaagcatttgataaaaaatagtccaacaatagtctaataaatagtctagccaataacaacaatacagcatatgtctgaagctggcagactacaccataaaaggcagttttgtctgacctgatggcaatcagtttggccaacctgtaacacacagccaaatacagccattggctccaaggctgcagttggcttcaggagctagaaataagtgtaggagtggttcttacctacctgcctgacactctccattccttggaggaagcagtatcaaatatttgagtttattcaaaagtccatccgtggattgctccatcttggtagtcatatataaatatgtaaaccatggaagtttagaaaattcacctagagtgttttagccgaaaagaacagataagtgattttgctgcaatctgaatttcactgcatctaaagatacacatagaattgtataataaaaacacatccagatgcagttactcttacttacaagtagccagaacctcaatgtggcattaaaatttctttcatactctcaaaacaggttttactttatttttgattatttttgtgctttcttcaataagacaatataaaaagtggaaacaagcataaattgcagacataaaataatcttctggtagaaacagttgtggagaacaggttgagtagagcaacaacaacaaaagcttatgcagtcaccttctttgaaaatgttaaatacaagtcctattctctttgtccagctgggtttagctagaggtagccaattacttctcttaaggtccatggcattgccaggattctataaaagccaagttaactgaagtaaatatctggggcccatcgcacccccactaagtactttgtcaccatgttgtatcttagaagtcatttttcactgtttgactcagaatttgggacttcagagtcaaacttcattgcttactccaaacccagtttaattccccacttttttaagtaggcttagctttgagtgatttttggctataaccgaaatgtaaatccaccttcaaacaacaaagtttgacaagactgaaatgttactgaaaacaatggtgccatatgctccaaagacatttccccaagataactgccaaagagtttttgaggaggacaatgatcatttattatgtaggagccttgatatctctgcaaaatagaattaatacagctcaaatggagtagtaaccaagcttttctgcccaggaagtaacaaacatcactacgaacatgagagtacaagaggaaactttcataatgcattttttcattcatacattcattcaataaacattagccaagctaatgttccaagcactgtgccaggtattaacaatataacaacaataaaagacacagtccttcctctcaaggtgttcagtctagtagggaagatgattattcattaaaatttttggtgcatcagaatcatgaggagcttgtcaaaaatgtaaattcctgcctatgttctcagatattctggttaggtcaggagtgggaacccaaaatcaattcttttaacaaacactaaaggtgattctaacacaggcggtgtgaggaccacactttgaaaaacactgctatacaatgtgattattgctgagagagggggatgcttggggtgtctttggatctctaaagagggatgcatcatcaagtctaaggaataaagagttagtctggttgagagagatagaggtgaggaaaggtagtccaggatagagtcaaaagtagggtggggaaattagatctttgtcccagggcactaaaatctaaaagacaccacaataaatgaacagttttggagagccaaggacaaggcaaaggaaattgttctactggaatggaggttgcattttctgtacttacagcattttcacactattcctttaatttaagaaaaatttctgttgtttactctgggcattaaaattgttaatcatgtttctgctgcaggcccagagaataacttgtgtgaatagttgtgtaaatagttaaacttggctaccttaatcaatgtgagggggaaagtggcaaaagattaagctgtgtaagcaaacagggacatgaaaacccagactctgtaaggagttgggaccttctactgggtgctaagggagccagtgaaaagtttgatgaaggggaaaaaaatcatttttttttgtttaagaatttggggatatgccctagggaagagacaaaggtgactgagaaatgaaggagaaatgaaggacatacattttaaagcactgttacgctgtattggagctgggagtaaggaaagagattaatatttatggcacacttaggaaatgtcaagcgctgagctaagacagtttacatatgctatcttttttaacctttgaaacagccttgtgaagtagacattattttacagaggaggaaacaggctcagagaagtgaggtacttgtcctaggtcacaacgctaataaatggtacagaaactaggatcatttgaatccaaaggttatgagctttccactacagcaaactatttaccagcactgatgaattttactgaggttgttcatttcctgattagcagtaagcacatatggtatttaaaatcaaaaaagatgacattgctgctagatttatatttttgagccttccttgtgtgtctgcatcagtcttgccttccacattaagtgaacaaacaatacataactgttattggggaggattatatactttgtttcttccacagaatagtaagccatttggcagcaggtagagcattttgttaatatgtgcactcccatggcagtagtttggtacctggcatctaatagtttattgaatgaattaataaatgagcatccaccaaactaggggaaaggaagaggggagttttgacatttcaagtctccaatctgagggagttgttatggctaccactttgtaattttacaacagtaatattttcacaaatcccagaagacttccgaagccaacttagctcctggaaaggggaaagctctggctctctgacatccccaatcccttcgatggaaatttaaaaaaaaaaatcatagactacaaggctccattcccttcaactatactggttaggactgggatgaagtttgtctccatttgcgtggagggattggctaagagaatgaatactgtaaacaagattgcaaaaggaatgattatttatcctatttaagaaaacaaactgttttcagacattcttgagcacttcagaagtgttttatctgaaaaagcaagtacatttatatgggaatagttggtgcatcaataatactcaatttttactgattaagtaaagtaggttcctaaagagccttcactgtgcaactttttaaaagcctaattctcataactgtgtgtacttgggagtagtaaaactttttttttaatagtctatgacagaatttttaacaattcagatggccatcctcaagtaggtagcatcacttctacctgatcaattttctatccagcaacagcatctcttgtgcaatcttgtctgtaaatctctgctaatccaataaagctcttcccattatctgtgtcatggttgcatgtgtatgtgtgcgtgacaggagggaggaaggcaatgatggatagagggaggaaataaatgttgattgattttgatgtttcctttaggggacaaaaatggatggtgtaacttattttcccttccagtatatttctcactcaaattagcaaattaaaaagttttttgttctagttcgaggtggtgtttggaaaaaaaagttttttgtgtatatgtaatatataaagtgaatatgcataaacatacatacacaagtgaatatatataaagtacatatatgttcactttatatattacatatacacattcatggtttcctaacaaacccttgatgataggttttcatcaaaagtaaaatataatatgtgataatttgacactgttcaaaattctacatggccaaactggccagtactagaaaggctgaccaccccccgctctggcttgctagctccttattcagggcacctttccacattatttaactagaattaccctaattgcttccaatataatttatattcttaaatcattgggaatttttaattctccaatgacaacagaggcattttctaaatttttctccaatggcttgaacgcagactactcagataatttgttctgaaaaactcaataaattaattcaaatacaagctttaatgcacaaaaattaaatctgcaatatctagttattttggatgcttcaaacaaactttattttgtgtctcgtatattgaacgctaacttaggtgtaggaggggaagaactgctgaactagagagccagtgaattatatactctcctgaaacttaatgacaggttttcatcccagaaacataaggggattcttgaggcctgcagttgcattcctgccgctcagggtaatcaataaaatctggggcaggcaagccagacaggatcattagggatttgttccagattgtaaatgttggacaaactggaagaatgaaggtcacatcaaaagtatgaagatggagagagttagctgggtcatagaaagacagcatattgttgtcataatccaggaggacacccagacgcttcaggtgtgggggcacatccaccagcatttccttgttgttgtgtctcaccacgaagttactattgcagcgagagaagacccatgaggaggcattcttgccaatccattcattctttggagctgatttgtaggcaatgccaattgcatacctgtgagacagtggaaaggagagagaaataaacatttatgaattatctgagttgtgtaagacaccatatatgatatataacaaataggatatatgtttattccttaaatagtttacacttagatgcataatgctgatatcactagagctttaaaaagttagcaattagagcaatgtggcagtttccatctcctagcccagtatattttccattattttattaaaaagctggcaaatttttctaggagtggttttcatcacataccttttaaccttgacttattggtattatggttgtgctatagaattgaatctcctaggaacctaatgacagaggacagaaaagaaaaggaaaatgggatccactcaccatgttgaggaacccatgaccacctcccaatagtggcagccactgtcaatgaatatatttcctgctgccccatagcaccctgtgccactaaacctctctggggtgtggctcttctttagagagctttcatccttctccatctgcaatccatcattggagatcttcaacttcttgtgagtcattttgggatccaatttaaagggttggcctgaaaaataagtagaaaaaaaaaaaagaaaaagcactatgaagtatcttaaaattctaccttttccaccagcatcatcactggcagggtatgctcgataacatgatcactcttggtccagtgcaagttggctgctgtttaaattttattaagaaaacaggccagaaaccagagttttcaataaaataagaataaaggccaatctcccataaaacgaccttcataacggcgtttattttcccactgtgggaaaaaatgtggatctctcctaaaagcaatttgagggaagtcatattccaagcaaagaggagctaataagctgtcccccacatcatatattatcaaagtaaaagggagtgctcaaagtttcatgttctcaaatatgttttgtactttgcttaatttcagtgggttgtttgggatttgggtagattttaacagaaagagtgttatgatgtctgaggtgaggggaattgatgtaattgctgcttgatggcagaaccggaaaaccctgagaactcagcaactgaacaattatttttgccctcttacaattgggatgtaaataacatataattaggcaattttgttagagtgactgttgcatcatcaatgatcagagaaaacatttattgtgtaggatcattcacaacagataattctttataaccatatgacaaaggcattgttactgagggaccagttgctgggtgtggcaagagatttttatacagaatgcttctgtgacagacactgttggctaacacattaccctttcccaactttttctctcttactcactttcactatagaggccggaaaagctaaatactcaatcttccagcctcccttactgctaggggcggctaagaacatggaagcagatggaagcagaagtcagacagagcaggggaaagttctaggaaagttttggatttccagataaaagggataaccattatgtgtaccaactctttcctctttcctatcttgagaggtaatatgacatctgaaagttgcagtggccatcttgcagccatgtggcaagaagccaatgcacacagggagaaggagcctgcatcttttatgacatcgcagagcagctgcattagccctgaactgcctaccttcaaacttcttcctatgtgtatgtgtgagagataaaatatatactattcatttaaacaattaacaaacgctatttgttaagctatgttagttgcactttttgttatttgctgtcaaaagcattcctaacagatatggcttctctgtagtaagattttactagattatcacaaataatgctcttttatgcaattgtcccccaaatataaggggtggagtacagagaaaactcttcactaacatcctcccaagctaacagtctttttgtgcatatctctgagtccacaaatctcccatgggcaccaacaaactccttgcccaaagtacaaactacaacagtatagctcctctacccagtaccactgctccccatgcactgctgtgagtgcctgctcaggctgtgtactcccctggcatggagaagaaaattgatctttccttttgaaatcaccacaacgtactgtttgtttttagtcgggtaggttcactgttccggctgccggcttggtttatggctttaacgatgaagatgtagcgagtcccgctctggagtccatgcactgtgtaatggttctgtttaatgttgggaacaatcatccagctgtctactgaattatacaggcctgtaacatggggaaagacaaggacattaaccagcaggtaagagagacagaatgaaaaacacactgaaaattcatcataagccaccccctcaaaagtgaattcattttgttttcttttgagtcttagaagatgtaatgagatgaaccagggcttatgattccactatttcattactcccatagaactaggcttaggccaggctccttgcttgtggcaattgaatggaactactagcataagttaggttatttcaatttctttcccagataacacaggaatggctactatacagagtcacggaatcatcactcttatggagtctctggatatttactccaaacgtccactcctctgagagctgagtttggtcttgtatggatggagcaatcctgtgcagagcagggaaacatggaaactcagccaaagggacacatagatactgtatttcccttattttacaaatgggaaactaggattgagagaagaaaagtgacctgcccaaggccacagatagtcagtgatggtgctgagaatagaaccctggtatttttaaaatggtagcccagtgttctctctactacatcacagttcatggggtgaacaacaatgttcttttgtctctgcaaggtagtgaggctctcagggcttacaattccactctcctactccatccttacccttacttcccaaactagccggtctccacagtaccgtagggaagccaaagagatgacatgataaccaaagcaagatatcatctccccactattacacaacacattctgttgtgtgattcccatgttcattttgggttgagtggtccaggagcacattgttatctggaatcttcctcccttccaagtagggaaagggatcagagaactaggcttctgcttttgatatattttagactgcaaatattaacttaaacaggggaaatgtaaataattaaaacatgtatttggcaagctttcggtaaaagaaaaaccaacattctagtctgcagattatttagacttctttctactgttatctgcttttcagttagtttaccactttttagccacagttctactagagggtagaaagggaaaggcgaggaatataagcagtgaattcagtcatttctatgcaactctagtacaaaatttagtgaggttgaaaattgaaaataataagtcatgaatgttttgcaagagatctgatcaaagggcttataattaatctgagaggaagttgaagagcctaagttaaaactagtaaaagaaacgatggagggcaaacagatatgcaggagaaagaggaggaagaattggtggaggtgcccagtgattctaatgaaaagacaatatggattaaaagggtaggagcaatgtttgaggccttgcctatgttaccaatacacagtatgaatcacaagctgcacataagattttaatacaaagaggaaaacatataatctccagatacacacccaacaatacaaagacaaacttcacaatgaagtactatgcagctgtgaaaaaaatgaggaaaagatcactatgaactgatatagagtgatttcaaggaaatattgtcaattgaaaaaagcaaattccaaaagtatatatgtatatgtagtatatatgcagtacactacttttttgagagaaagaaaaataagaaaacatccatatatttgcttggatttacaaagcaacaacaataaaaacaggaaagataaataaaaaattcatgaagttggttatccacaaggggtagggggtggaggaacaggattaaaaggatgtgggaggaaatgacatttctctgaatgtacctttttgtatagcatcctctttgggaaacacattgttttacaaattcaaaaaaataaaattaaatgaatacagatgggaaaattggggactaaagctgaaggcaaactgaaacaaacccaactgcatttcagacgaacagcataattacatcaatgtagtgggggtgggaggaaaacctcaaacaaatcctgaagtattgttagccagtttgtttttgttgtggcgtggacagagcaattcagaaactattttagatgtattatgggattgagcaaatgagtacatgtgttgatgttgggagccagggttcatactgtggaagaaggaacatacaaatacagaatggagaaaggcaggaaggaacctgtggggatggactggaatttaaggtattggtgtaaactcatgatttctaaaatatatatatgtttgtgtatgtgcacataaatatgcacatatataaagtatgtatgcatgtgttattatatatgtgtgcatatgcttacatgtatggatatttgtgtttatatctagcatatctagcactcaggtcttggtctctaatattgtcccactaaaagaaaccagggtttcttggaaaataatgactgatttcaaggctgggacagaataaggtcaaaatgagcctagaacattttgttatgccagaaagtaaggaagtgctcaagaaaatgatgggggaatattataaggacccagaaatcaccttgaaaggctcccaatggctaaatcttgacaatttgaacaccaacacaagtaagggctgtaaataattattaacaattgaaaaaagataattcatcagcccatactgatatataaacaaatgggaggaaatggggagtggaactcttgcttatagtagaatgccaagtgccaacttgaaaatgtgggagggaatactcaactggaaaaatcatcattttgcaatcatcatattaatgattgattcaggcaagtatcatcaactgataataaaacaagggtgggggtagggatgagatggtttgatgaagcagcagggtatttttatggttttaaaacataccacacagattccttattagtggcaaaagaaaaagtagcaactacagtgaataaatcagacgacatcttgactaggtgatcaaaattagcatcatcagtgaagggcaagtggacatcatgtgtctccagatattataccctaagaaagaactgtactgctaaatataatcatgagaaaacttcagaaaaaatcaaaataaggaacagtataatgaagtataataaagacataaaagaacactttttaaaaaatgtcaatgttgttcaagacaaagaaaggctgaagaaatgttccagattaaaagagatatggcaaaagagatacgacaattaaatgtaatacctgaccctaaactataaaggacaatattgggttctttatatgtcataaagaatattatttggtcaaatgtcaaaaattgaaatataaatggtggttagataaaagtattgcatcaacgttaaatttcttcaagttggtaactatactgtggttatgtaagagaatttccttattcttaggaaatatacactgaagaattcagaggtgaaagaccatgatgtatgcaatttgctctaaaatggttccaaaagaacagggaatgttagcaaatgctaaaggaaatgggacaaatattaacagtaggtgaatttgggtaaagaatatatgggtgttctttgtgctagtcttggaaagttttctgtgattttgaaatcatttctaaatttaaaaaggtaaatatatgatcctctaggtattactgagatttagtaagatgggacttatgattgaattatgtcagtggaagtatacctcttgttcaaaagggaaaaattacaatatggaaatccctgaacctgagtgtaaatgtgtggtagagagtatttgcatgagaatgaaaaggaagggaaatagaagttatgtctttctggtagtatgttatggtccgcctggctaggcagagtttacggctaatgcttttgtaatgcaaaacacaaaattcaaacggaggaaagataataaagtaatcagaagacaaacacactcaaatatctgttggaattctcattcacctcacagcataatctgaaacatcattggttgtgatcatttcaaatcttagaagaggtgggaagaaagttaaaaatcaggaaataaagttgaaagaaaaggtgaagggggaataatcctcaccaacaagcatgaaatttctggataaagaaaatgtgaaaaaacgtcaaaggaaagtagctctcagaacggaggttcagtcaactgtggcaggccagaccggcaggtaggattgggatcctgaatcttcaaaaatacttattcctagtaaaatagtttctcattgccatccaaaattttgcttcaggcctctgcccttgtccttgttctaacaaaattttctatcaataactagaggaagaaatagaaggcaggctgtgagggtaagcaagtatatttgaaggtagaatctgtatcccaaaggattttagcatgctgaaatgaagtggcagaactaaccagataaaatgtactagggataaattcaaggctttgtatttttgttttagacattcaattgtataagaacaggatttggaatacatagaaaattcagttgatcatatgctcagtaaacagtcagtagtcaaagtggctgctgaaaaaaaaggtacagggcaattgggaatcagctaatgtacaagagaaataatccagctatcctctgcagtgctcagaccactttgggagtactacattcacttcattgacagaacattttataaagcacagtgataatcaggagtgtgttcttaaaaatgatactaggataacaaaagatctgaaactatgccatatgaagagcaattgaaagaaaggaagatgcctagcctggaaaagagaaaatttagaaggacataggaactaactaaaattatctgaagaactgttatgtgaaagatggattaggtttgttagtgaggcacaaaagttcagaactaggactaattggttgctgtggtttactttaaggagcattaaacttgaagtctgacaggctcaagctgcaaccttgactccctcatttcgtagctctgtgactttgggcaactcactcaacctgagccccagtttcttcatctataaagtagagttaataacattttataaggctaagtaagcacccataaggactaaatgagataatgtatgtgggagcatttgtaaatggcaaagcataatacacatgtaaattattattgttgttattatttactaaaaggaagagttaagccccttataaggaagcactggccattatttatagctgcacaacaatcaaatgggttgttttgttagaagtgaggtacctatcactggaaatgttcaagcagagacaggatgattatctactgggtgtctggtagaagggaagaagattagactagatgacttctaagctccattccaattctaagatgctatgatcctatcactgttaagaattatcctttaagcttttctttacaaaggactatataaccttgaaaacagaggtgacaacctttagatctttgtcacttctcagacttcttcttaattcctgggagatgactgctttccccatatcaggaaaaagaagcacagttgttggcgctaagactttccagagtaggagagacaaataaatcagtgaagcattagagtttgtgacttcacaatctgaagaaacacccaggaacatagttacatgggccaagtggtttaggttggagctgcacgaagcaaatgttttttagagtttgatccccaaatgtcctctcatctccccaccccaccttgttacaaaacagaattctgccccagatttgtcacaaaacaggaaaaggaagcctatttgaaggggttagttggaaaaactactctcatgctggcctgtgaagtcagacacaaaagcaggaacaaaaaagtaaaagaaaatactaatttgcagctatggagatgttattttaggttgggaatctgttccagtcttgaatccagctttaattttgcttttgtttccatttccaccatccctcaccccagccctcactgcacccagggcattgaggggaactttcagctcatcccctcttgactggcatgagtgaagttcctactctgttttgtcttgctccaattcaccagaaagtgaaaccgtaacatgtgagctaaacaacagctttgttaacctttttcattttgtggcccactgacatgttttcatatttagcataattcttggtggaaaggaagaagtaaagggaagagtgacagaggcaggaggcttgtcaccatattcactgatagaggtaggtttggtaaaggaaaagtctttgaacataatgtattttaccacgataatgaagtagaagaagagtcaaggagagagatgttcatacacacagaaccagcaatgatggtggcaaggaacaagtaccaagctgtactctccttgggaaagtggagtgacatggattaattgaggaaaggctaagggttacataaatgaatgggaatggccccagcaactgcccagcaaggaaatatacaacttgcttgttacccatcagtaaggtctttgcaatgccctggggagcttacactgtctatgaaacactatactaaacaacctaacatgtcttacaaacacttgcctcgtggcgccccggccaatcttgagcagcttactgcttccttacatttccttatctctggccacaggccccaactacaccatgacttactgatgaagttagcctggccagtgaatatggtgtactgaagctcataggagctgatgctgaactcatcatccgagatccagtggactgtaatggtgtcatgggaggcagtacagagttcttctcggatagatggtgggtttggggctgtaaggaaaggtggaaaagaaagtaaggaaagcatactttctcttctggaattttacaattgttactcttcctgcgtaacccaacatctcttgaagagattttcttaatagagaatctttagattgcatgaaccatgcaacctgaagcaaaatgctgggatctcaagctccctaaaaccacttttgctacatcaataaaaatattttagcaaagatataagcctaaatttttgtgatgactgccccagctgtctagtctgcctgcataaacacttatgtagacattaaagtgattatatggttttcttaacatacggtcttcaacttatttttttaaatttcaaaatgagtatatatatatatagacagatttttgctcttgttgcccaggctggactgcagtggcgcaatctcggctcactgcaacctctgccttctgggttcaagtgattctcctgcatcagcctcctgagaagctgggattacaggcacccaccaccacatctggctaatttttgtatttttagtagagacagggtttcgccatgttggccaggctggtctcgaactcctgacttcaggtgatccacccacctcggcctcccaaggtgctgggattatgggcgtgagccactgtgcccagccccattatatatttttagctgtatagtcaagtgcaaaataatgagttccctcatctataaaataggggtgataattaacttatagatttgttgtaaggtttaaagatacaaaattaatatacagtgtctagaataaagtagatgttcaataaggagcagctatttaatatagtaacaaaacagttcaaaaattgtttgtgtatatttttttcatgaaatgatcattaaataatcctgaaagtagccagcatttttaacaggctggttgcatccctcattttctaaaattgtctgagagccagatatttcttacatttttcttcctgatctactaactcctaattttccttaaaaccattttggttgtacttacacccacataaggcattctctaatattccctaattgtcacctgagttctactctcataactagcaacaatacattactgttagattcataaggacaaatctatcagcaatttcttgtgttttactcttaagtacagatggtatacccattttgaccctagaaatagttaacaaatcataaatcatctttttttctgttacatgaactaaaatatattctgtctgaaaagacacatgcatcattttaaagattataaaatatgtaaattataaatattgtctttttcaaattatttttaagtaaaagcataccagaagaaaaaaaattaaatggaaaggaaagcacagtattttcacacctgttaaataatctaacccctctagcagtttcttttctctggaaaaatctaaagcaaagttttcaaaggcatcattaaaattgatgtctggaatcagaacttgagaagatgcagttgccatagcgaccctgaaaaagagaaaagtacatcaatatacatcaaaataggttgcaactttcacccagtgtttgatttctggtttaacaaggagaaaataaatgacttgtaaggcttgatttatttagtgaaaatatcatatctctgcctttccaatggaaactatttaaattttaatcatcaggaaccaattaagagttataccatatttattcacatatgttcacccctcaaacacactcccccatccggtcttaattttgagaagtaaatacaggattttttcccctctgcatcattttccatctggcagacagcatcaaaactagacctttaaaggtttggtaaaaacagtttaagagagatttttcttttttgtttatgctagtcagcaagtcagcatgctaggttaacaccttccctaaatatatcctttatgtgatttttttttttttgagacagagtcttgctgtgtcacgcaggttgcagtgcagtggcgccatctcagttcactgcaatctctgcctctccgacccccttccaggttcaagcaattctcatgtctcagcctccctagctggtggcccgccaccacacccagctaatttttgtatttttagtagagacgggattttgccaagttggccaggctggtctcaaactcctgacctcaagtgatccacccgttttggcctcccaaagtgctggaattacatgagctagccaccgcacctgacctatgtgatcttttataatatttatatttcactttattatcctcagattgtatagtgctatgatagttttatcttcccaactaaatctaggagtctcaagagcagggttcatattttgtacctcttaatatcttccatggccctaacacagcatttgacacatagtgaaaaaataattgttgaatgaacaattgaatgactaacaacaaaataactgctaacatttattgggtgcttagtatatacaatgctctgtgcattcactttacatacactatctaatttactctttaccataacactatgtagtagatgttatttccattttgcgaatgagaaagttggcacattaaaatgctaagtaacttgtccaagatcacacaaccagtaagagtcagaaatataattgagcccatgtccatctgattctaaattctataaccttaaccatttagactgttcttttcttcaaaaaattgaggtatattttatatatttcagcaatttttagccatcgctacacatcaggattatctggaggagcttttgccaaaatatacatgttttagtcctgtgcaagatcttctaaatcagagccaatgagatccttgaacatgtaaatgatggtgaggaaagaaaaattcacttggcaataatatgtaggttagaggagagagaaaaggcattgaatgtaggaagaccagagaggaaacttttatggtgaactagttgtaagggaatgggaaactgaaaaatacatatcctcatgtacatataccctgctatacatctaccaacaacacctcttattgtttctgaaaatagagatgtttcagtgataaactacaggccaaatgaaagactagctcagtacaatcataaggtctcacatgaatagccaggatttggtgagtaaggagacaacaacttctttaggataacagttaatctagaaaattagctcatggaatttctttctggcctctccaatcttctttatttcctccatccatctatccaatacttattaagcacaactaatgtgccaggcactgtactgggcactggagatacacaaagtgaacaagctttgctgtggttcttgccttcaagagctcacacatcatgaaggagaaagacattacgtgggcaatagaagtgctgctacaaagggagtagagcatacacaggagttatctaaagagacttgggagctaagggaaatctcccatgtggaagtcgattttcaccaatgacctatgtaatgagtaagagttaactaagcaaagactatgtggatgtgtgtgtgttctctcttgtttgaagcctggagaatgagacaaaatcatgcaggactttgtaggccacgttacaaacgttggattttatcttaagaacgatgggggtcactaagcattaggtggggaaataatatgctgaaattcatgtttcaggaatactactatggcttcagtggagggattggaaagggtcaaaattggaggcaaagagaccagattttaaagtgtcttggaataagcatgagtgtaaacaaacaaaacaaaaagggttaattcacaaagcatcaaagaaaacaaagtcaaagcaaacaaatggccaataaatatatttaaaaagtccaactttatgagaaatcaaagaaatgtaaattaaaatgagatagcgtttaaattacaaacaaatgacagcataggagcttttatgcctatagtcaataatgcctacatatttgtattaggattgaaattgatacatattttgaaggccaaattagcattaaatttcaaaatagcttaaaatataagtcttctttgacaccacagttctatttcataaaatttttattatggaaataattgagatgtatgcaaagatagaactacaagggcactcaacacaccatatgtagcctgattgtctaacagtggagactgagttaagtaatgtactatacatcaaaagataaaataacatgaagcaattggaaatcaggttttataatatccaatgatatagagaaaagtttgtgatacattgtttcaaatgtagagtataatatagtatatatagcatatcatgtttgtgaaatatatctaaatagaaatattagaataccatattcctaaatgttaatgatggaccaaaggttaagaatgggttaaaagtgacatggtggggtgtgtgtgtgtgtgtatctgactgtctgtgtttttttatttaagcaaaacacaacattagcgatcttgttgcagtctctcaaggccttggtttctattgcacataatataaggtgtcatttgtaaggggaaaggcatatctctcccagctaaaatttcattttaactgaagtcatggtggcttaacacaatacaatgcataatggtgggggaaaatttcagaccctgtgggagaccagtattgaaggtgagtagatgattctcaagtcatactacatagatagtcatctattccacctacacctcaggttatacctgagcctatgcaaagaagattcagataaagagttgggaatcataaccatctagatggtaattgaagccctaggaaccaatgagtttgcaacaaggagaacgtgtaatgagagaagagaataacctaagacacaatcacaaagaacaatagcattaaaggaataggccaaggaaacattgctcacaaaggcaaaacaaaacaaaaacaacaaagtaggaagaaaaccaggagtgttcatggaaggtaagggcagagaaatttcaagtaaaaatgttcaggaggacaaatgctactgagagatcaagtaagatgaaacaaaggggtgtctattatatttagcaacaaggtattcatttgatgaccttgaaaagaatactttcaatggtgtggtagtgggacaaaacatttcagagggttggagagcagagattattaaatacagtggtttgaatatatgttttatttttgctttcatgaaatctcactgaaataacagtcaaagaatgaaatgtcataaacccacaaagacaaagagaatggaaaagagatgccaacaagtaaaagattgtcaacaaatgtttggaagctagaaagggatgaatgtgtggtaaccaataacagtccagagaaagctagatcaggaagccaacaacatcaagttgatttagtgccacagaaagttgaaagtttgcatgaggaacaactagatccacagatccatgcacactaaaccagagactacccttccctcattctggcaggatatgtgagttttactttctgctgatctttgacattatactaaaagcagtcttaaaactctcagctccttttccctccttggctcccagaatgctggcagccaggcttataccttccacaccgctgcccctccaatcaaaagcaggagattggaggatttcatccaagggaaactgacccaagagaaaagacctacagaactgacacttgggagtccatcaataaaaagccagcattccgccttataatcctatagcaaagttcaccaacccataaattattcccatccactcagagtttccagtcatcttttagtgcttaaactcaaacacacagccagtagtttgccagatatttaggaaaagacagcaatttaaactaacagagaaaaggaactgggaggaaacccagacaatgcagggtttagaagcaaacttttaaaaatgacaatattctcaagaagaaaaccaaatagttcgtatccacaaagcaaaaacagaatgctaaaaaagaaacaaggtgaaggatgagctcttgtgaataaaattaggaatgctgaaattaaaatttcaatagaaggatttaatgaaaaattaaggaagtatcttagtaaaataagaagacaaagtcatggaaaatggaaaagataaaattagagaaaaaaagtctaggatgtccaacagttcactaatcaaagtcccataaacaaagaagagaaagaataaaggggaggaaattattagcaaataatacaagaacatttcccagagctagaggtcaccagtctttagattagaaagattcactgagtgcccaggaaaaatgaatgacaaaaagtccacaacgcgccagacacggtggctcacacctgtaatctcagcactttgggaggccaaggtgggcagatcactggagatcaggagttcgagaccaccctggccaacatggtgaaaccacatctctactaaaaataccaaaattagccgggcgtaatggcgtgagcctgtagtcccagctaccagggaggctgaggcagaagaatcacttgaatctgggaggcagagattgcagtgagctgagatcgtgccactgcactccagcctgggcaacagaacaagaagaaagaaagaaggaaagagagagagagggagaaagagagagggaaaggaaaggaaaggaaaggaaaggaaaggaaaggaaaggaaaggaaaggaaaggaaaggaaaggaaaatctataacagaggcaaatcttgatgaaatttcagaaaaactgggttaaagataagatctttaaaacttctagatcgtaatggctattattaaaaggaggaaggataagtgctggtgaggatgtagagaaaagggaacccttatacattgttggtgggaatataaattagtacagccattataaaaaacagtatggaggttcctcaaaaaactaaaaatagaactactgtaggatccagcaatcccactagtcagtatatatccaaagaagttgaaatcaatatgtcaaagaaatatctgcattcccatgttcactgaagcattattcagaatagccaagatatggtatctacctaagtttctatcaatggatgaatggataaagaaaatgtggtatagatacataatgtaatacctttcagccactgaagttggaggaaatcctgttatccttgacagcataaatgaacctggaggatgtatgctaagtaaaataagccaggcacagaaagacaaataccatatgatctcgcacataggtggaatctgaaaaaatcaaactcatagaaatagagagtagaatggtggttactagaggctggtatgaggagggaatggggagttgttggacaaagggtataaagtttcagttagacaggaggaataagtttctgagatctgttgtgcagcagtgtgaatataatcaataataacatattgtatgtttcaaaatagctaaaagagtaaatctcaatggctgaccacaaaaaatggtgaggtaatggatatgttaattggctttgattagtcattccacattgtatgcatatatgaaaacatcacattgcaacccattaatgtatacaactatgatttgtcaattaaaagtaatattaacttttgtttaagcttctggattttaaaacataggttatattcaaaagatctggattcaaaacggcagtgaacgtctcaacacaataatggaagccaggagacaatgaagtcatgccttcaaaatttatttccaacctatcaagtgtgaaaattaacttgaaatatttttaggcaaaaagttcttgaaaatttacttcccatgtactctttcttaagaaactacaggagcgtttgtttgaaaagcttaagggaatcaagtggtacaggaaggggaaatccaggcagagcccaatgagttccctaaaattaaggagacagagctgagaatccaagtggacgaagttggctggagttcacaggacatagtaccagagaggaaaaagctgcagagagaattctagagaccttcagagtttccctctagtagtcaacagaatactgatcaacaaatgcatgcgaggaaactgcataatgctggggaaagagccacccaaaaagataagagggaacaatccctggtactcacataggtctagcaatagtgtgtgttcctaccagctaaactggaaaatctcatgactcacaggacactggaatagagtactcagaagggttttgcctcagtagtggagaaaaattgtctctagactaaacattgctctgatctcacctatcaaatctgaaaaccaagacttgaaaggatcaagctgttttcaagtaacttaactgtgtctcagaacaaagtttaagaatatttataggaatacaaaaatatacagcatcccgaaagagaaaattaacaagtctgatatccagtaaaaaattacctgataggcaaaaaatcaagaaaatacaatccataatgagaagaaaaggcaaccaattgaaacggacccagatatgacacaggtattagaattagcaagcaaggacataaaagcaattattttaactgtattccatatgttcagaaagctagaggaaaggctaaatatctttttttgttttcagagacaagacattgtcctgttgcccaggctggagtgcagtggcagcatcgtgacccactgtacccttgaactcctgggctcagaagatcctcttgcttcagcctcccaagtagctaggactacaggcacatgtcaccagatgcaggcttttttttttttttttttagatggaatctcgctatgttgcccaggctggtctcaagtgatcttcccacctcagcctcccagagtgctgtgattaaaggtgtgagccaccacacccagcctgaatatcttgagatatggaagacattttttaaaagacccaaatcaaactagagatgaaagttataatatctaagataaaaaatacactggaggggttaacagcagattaggtatcacagaagaaaaggctagtgaacttgaagatatatcaatagaagctatccaaaatgaaacacacttgcatgtgttttcacaatggcaaaaaaataaaaagactgcaaaacaaaaatagagcattggtaagctataggacaatttcagacagccaaatatacatgtaattggaatcccgaatagagaggaaggaagtggcataaaaatatttgtagaagtagtggcagaaaaaaagtccaaatttgcagaagttaattgatactgtctaaagttgaaaaaaattaaaactaccaatgtaaggatgttatttagaaatgtaaggtcatgccaataaaaacatctgatagagctgaaattgcttggctttgttgtaaaagtgtagactgtggcactagactccctaaatttgaatcttgcctgtgccccttactagttggacaattgtaagcaagttatttaacctctctgaacatcgttctctcatttataaaatggggataaaagtagtatctacctcataaagtttttttgaggattaagtgagttaatacttatgaaggcttaaaataatgcccagtacaaagtaagaactctattgataatggtattatcagagagcagacattgagaatgaggagattgctatttcttgcaatatgacttatagtaatattttactttctaactatgcacaaggtattacttggatataaatacattttaaatatttcagaagagtaaattaggggtgaagaaatgtaaagtctttcgcgaagtttgctgtgcagggaaggagagggacaggtgataattggaggggatatgaagtagaggaaagtcatggggtttttttgtttggttggttttaggtaggaaagacatgagtgggttaaaaatggatgtgaagtcaactatagagagggataaattgaagctatggaaaaaagagtgtatttggccaaagcacaaatgaagagacatctcttccattttaatcagaaggaaggcagaagttaatggatgtggacctaagtgtgttcagaagtttgatatgagaagttgaattcgctatttcacacttactgttctttgtaaaataagagggcatttactgagcataagcagaaaagtggcagagttggaattttgaggtaagtacaaaagatttgagatagccattatgatgacaagttaaaaagaaagctgaccaaagcaatgcagaaggatttcaggttagcactgaaggcccaggtgaggtttagaagctatacatttgtgatgcagtagtaccaacctctttggttatgtgattttctccagtagggtgctgcaactcaaatataggaatggaaaaagtgggactgattcaggattaggactttatcaggttggtatgttaaaaggacaatggggcaaggggattgagaatattgaaaagagagtatctgaagtgagaaatcacagatcctaaataggctaaagaaagaagcgaagacaggaaatagctggtaggtcggaagaaagtataggagtcaggccttagcagtctcaacaaagttgaagtatacacgtatttgaagaaaaaaagaattgttggccgagggcagtggctcacgcctgtaatcccaacagtttgggaggctgaggcaggcatattacttgaggccaggaattcgaaaccagcctggccaaaatggcgaaaccccatctctactaaaaatacaaaaattagccaggcatggtggtgcatgcctataatcccagctacttgggaggctaagtcaggagaatcctttgaacctgggaggcagaggatgcagtgagccaagatcgcaccactgtactccagcctgggcaacagagtgagactctgtctcaaacaaaacaaaacaaaaataagaaaaaagagttgttaagtagagggtatagttaaaaactggcatgttttaagttatgatttcagtgcaattctgagtgatggtgaagttcattcagcatgtggtccatgaaaatgggtggatgagatggagctctgaggtgagagtcactgttggaggggatgttaaagaagctagatggctaaagcattagatgagtcagccatgtggttgttgctgaagtcacccaaaatgatggcagaggcaatgggaggaacactgcgagcctggagccaaggtcttcaatgaatgagaaggagatatatggaggtcaaatctggccttatgagcctctgcagccccttgaagtcttggtgactatactgaacaatgtttcactttagaccctggtttttttgccagtggtctatggatgggcttctaaggatctgcaagtcctctgaaatagtatagaaaattatctgtgtatatttattaaatgcattgtttttcctctggaagaaggttcatgactctcatctaatttagaaaggggtgagtgattaaataaaggcctaaaaattactgccataaaggatttatgtgcagaataactaaatgaaagcaatagaaactgcatgcagactgagaagagcacgcacctatcaatatagctaaaagtttctctacccttataccaacaccatcatagaaaactcatgcgctgagtgagcagcaaggagctatggcaatagctacggctggtacttgactgtgccttaaaagagctgataggctgcagagacagagacaagggtccagaaatccaaagggtaatttaccactgaggctcaataactacttaactggtaaaatcttcaggtggcagctgttagatacatgcctgaactttaagtgactttaaattggcctcttttcacaagagcaggcatttccaaagaatataaggaactgacctctcagcaatattttttgcagactgtagaaaccgtgcctggtcattttctttcaggatatgctcagcttggttgatgaggactgttgaccgttcaagacactggcggcaattagcaacctgctgtgccaactttctcagtttcataacctttaaggaattagtaaaagaaaaaaataagataaaacatgcagtgcttaattaaaaacaataaaaaacaacatgaaggaggcatgctgcagtgattctaaaaataaggtttattaatattccatggtccctgtactaaccactcaccttctcaccctacccactgtgtctcttgtgccaacccctccttctcttatctactgcttgcatacttaggctgcaacacagtcatatactctcggttatctacctcctctgtgtattagtaacactaatttttctggttataaatcaatgcatgcccattatagaaaattcagaaaataaaaagtataaaagaaacactaccacccagagattataattgtttacatttttgtttgtttacattttgttgtcaatatattttcacatatatgtttactaaaaagtaccatctttttctttatgagtatctacagttctatgtacatatttctctaagtgtctttatgcatacctgtgtgttcacaaatctgtattcttggaaactttagtttcctggataagctataaccactcagcatggcacaaattattagtgatcactctagcctctcaaaacatctcacattatacacacagcatgaacttataaccactaacactgacgagcaagccaacaagcctaaaaccatatagctgtatggaggctcacacttgacgcttatgatcatgattcttcagttcccaggctagaaacctgaatgtcttcactgagtcttccctctctctcattcgtcttttatatttaaaagttcaatgtttcctatcgtttcctttctagcagtgcctgttgtgttcttccctcccatttgtgctgccactactctggtttaggtctttatcaactcttacaaagcatcattccataagtctcataacttgctaccctgactttggtatcatcccattctgatctaccctgcatacctctgccatatcaatccgtctttctcccttcctaagaaacgagaatggctgcccaacacttttcagattaagcccagagtcctcatcctggaattcatggtccataatcctgactcacatttctaccattacttttttccttttcattgagttataacatacaacagtaaagcacccaaatcctaagtgtacagctcaatgaacttttgcctacacatacacccacgtaaaccaggtcaagatatagaacgtttctaacaccccagaatggccatcgtttttactggattcagagcagtaggccaaacatcacttctttgcctctccccctataatctcatttcttcttgatttcatgatcaaaccagaatcatctggatcaaactttgatatttgtaaagtcaacccttccttggattcactgaagtgctgcgctttacctttgtctctttgattttgacagcgatcatttgcttcctctgctggatgatctctaccaactcgtcacattcttccataagttttgcctcatgcatagcagtattcacctgccaagaaatttcagagtattacacagtgattgttgcctttgtcccctgctggctctaaaaggttcggactgacagctaagcatgcacaacttcttccatacctccctcataagatccactcctagaagaagggtagagatgatgatattaatgatgcaagggcattgaagcaccacagttaggaagctctccaggcctctggtagatcatgatggttaatggaaggctgggcagaaggacagatgagatgggggcatgttattcccactgaacaattccctttactccagtaccctttcctcctgctgttcttttggaaagagggtaaggagatttatgtatgtcaagaaaagagtatcctcctccacaggcacaatattaagataacattacaacaatatattgtgctaacaaaaatattttcagttttccttgttcccttctaatttttcacattaaatatatcattaaacatatattcatgtgtatatatttttcagatagttgtcgtgttttagtgggtatttctcaccttgggctgtccagtatctgaatacctttcctattttgggatactggctacatcaaaacatctttactgcaaagtcagggttggaaaaaaaaaaaaactaccattctgcattttctttccatggattgatttctccttctcctcatctctattattattgacactagatggtacagagcccccaggaggggctaaaatgagagcaggggattttggggctgcccaagtataacaggaaaggaaggagaaaagaactaacatctttttagtacttaacttgccaagcacttcataggtaaattatttcatgtaattatcataacaattttacaatataggaaccatgtttattcccatttcacatacggggaaactgaggcgtagagaattttagtgacttgctcaaaaatcacacaactagtaagtggtaaaaccagaattcaaaccgagttctgtcaagtgaaacccctgggctggctgggtgggcgggcgaggttcagttccatttcagcagcacacagagcagtcatacagggaagcacaagcattccaagagtctattcaaggatcactcgagcagagctctagaaggctgaggaacagacaatgggttacttgagagcatcaaaactcaaggggctagatgtgcttcattagcaaggtagggctgcatttccaattgctatccctcttcagagggttgctccatattctccaacccgagcaaaatacctgtcactggaccctactaccccctctctcatacttgaagctcactgatggctaattttctgtttcctacttaactgaaataaaatatgtctgttgctgagtgacaatcttatgttgcttttttccattttctagggcaatgtcacaactggggcttctgtttactctgaatggcactctagccattctacttttttttctcagacacctcaccctttccctaaattggatctacctttccaaggcagatatctcaccagctcacgaactcctttatctgagactaagagattcatttagttttctctgggtccttgcttacagtatctagaaacttagacacttgccatttataatttcttttttaggtggctactggtgtagtacacaatgatgtcgtacctggtttcttaaaatgtaatcctcggactagcctttacataacactatatgcctggcattgctctaattagtttacatatattggctctctcaatcctcaaaacagtcccgaggtaggtacctttatctacatttgacagatgaggaaaactaagcacagagagattaagtgacttgcttaaggttacacagttagtacatagcagggatgagatttgggctgagagagtgcaatactagagactacacgtttaaccttacacatatgctgctctccagttgagtgtaacaacacccttttcttcaatttctgaaaatcatcatctctttcaaatcatccatctttattctgtcatccgtttctcattagtcacttcagactccttgttgttcccctagaatgccatgcactttcatgtcctgtgcctttgcccgagattgtcattttacttggaaagtcatttccccatctgtttactgaacacatttctacttatcttttaaggcccttctcaaagatcatcacttctatgatttttctcacttgcttggacacaagcaattgatcccctatttatattttcacatactctatatatagttcaattataccatttcctatattttatcatattagtctgtcttcctcactccatcatgagttctggagggcaagaattgtgtcttatgtgactatatctagctccactatcatgatgggcacatagtagatgctccgtaattatttgttggattgaattaaatgtgaaaaaaggtatcttttactcctcattagacatgtccactttgttactcaagttaccctaaactcagtaagtctaaaaacaaacttatcaccttctctccagatctggcttccacctctgattttcctatttttgtgtcaatgctactatcattattgcagttactcaggttcagtaaactctgactgctacttctcctttgtccccacataaattcacagcagtcccaaagtccttccctcctttcctttttaatcatgctaaatttcctcagtggctggtccaagtgcagtagtgtttacaaccaactgatcgcaaatagttacaggtttctttgttccttctccattcccactgcttcacttgactacccttattcgttaatatagtgaggatctgagccaaggaaccaataggttgaagcccttatcacctattgtgataggactgttgttgcaaaaacctcgttaattaatctccctacctccagaatatttcctttgccacccatcctcataatccttcctctactctgaagccaggaaaaatcatgtcttcattaccagacatcttatcaagcatcttttctgtgcaaagcattatgctaaggccctgccctcaaaaactttgcaaactggatggggaagagccatatacatataaaagaaaccaatcaaggtagcataaattaaatactgaatgggtgatgtagactataatctactgaaattaaaaggaaagattacttttggtgggtaagtgaaggaaagatgcatggatgaaatggaagttgaattaaatcttaaagatggaataagacttagattaaaaaggtgtgaaggagagaaatttcaagccaaacaaatgagactgaactttatttttaggcaatatggtatctttaagtagtatttttgaggggaggaaaggtaaggtggtgcgagaagtaccacagtgaacttgtttaagaagatgaacagggactgatttgatggagggtaatagtaaacctgaggactatttaggaggctgttgtgatgtggacagggcatacccaaggagaatatcagtaatagaaaggaaatatcaaatataagaagcactcttttgcttacatatcttcaattagacagcaagctccttgagggaagattttacactactttgtctctcccattataactggtacaaagccttacaacaaacatttactgactgatttagcacagtaaaaaaatcaaaataagaatgccaagcattataaaatatactccagtgagtgtattttgtagagaaaatataaggtgaaatgagggagctagggtgggaatgttttttggacagtcacatcaggggagataaaaccaggcacaactaatagaatgaaaagttggctgaagaggcacaattccaaactaaaggtaaagcaatgacattaaaatcttttcatgtcaagaagcaccccagaagagcagggtccttaagtgttttctgaacaggaaatacttcagggaaaaccggtctttgtgatgtgaataaaacaactcaaattgcttggaagacatttgaaagcccctggtattttctttgtttgaagacataatacattgaggtatttcacttgcttattaacgcttaattgaaaataactgggttaccttaataagcatacttggctggttggttggtttgtggaagaccctagctctttatttgacattcgctctttgtattaggttagtggttttgtctaaatggctttatgtctgtggaaaaaaaatctatcctccttgaaaataccattaggtcaatcttggcaacctacttgtataaatccacccaccccaaaaagacttttgggaggcagtttgtgatgtttatgactaagagtcttagcctcaatcttccaagtcctaaacactaggcaacacaggctccctggtaagtctccaggtcctcttctctgctctttgctcttttactttcttcttaaggcagcaaaaatttgacttgcatatttctttccaactgcccatcctaccctattacctcccagcccaaagactgactgtagagtaagacctagtcttccccaatttccacctattcttaatacaaacacataaggcccctgatggaaggactttaccactgttcaatactaggaaataaataggtgggagttcgccaaagccataagttgcaaagatttaagaaactgcaaaaagttattttggcaattgtttctcttctgtattgaaatgtaaatggactagacctttttacccttagcttctttcagagagcttatttgatagttaggatttttggggggggggagggggagggggcaggggagatattccattgctcattctatagttattttattcctgggtttaaagttcatcagccttccctccaacccactcccacgataacttccccacttccactttcacctcagcttagtcacatccatcagtcctatagtgcatcattgcacaggagttcagaaggcactgagatttcctgttcagatggaacaagatatatgaaatagtagatgatcccatatacccagactcaagtgaaatgcaataataataataataattatatggcaaggaattcctcactggcttctccgtctcagtgctctccactctacacagtaaatgccagcctagtttattctctgaaatcttctgcccaaatagatctccctttcaccagaatattgtgaaattttggcattaaagttcatttggggaagtttttatttcaacaaacatttattgagtgtctcccacataccacagtatatcccacatgtatccagcatagtgctgggtttccctgagtgggatataacgatgaaaatgactcagcttctgccttcaaggcacttacagtctagtagagactatgagtgtgaatacaactaattataatttaaagaccagcaaaacaagtaatataatagaatacaattaaaggtgtatgagatcataggaaagagaaaatttggaaaaggacaatcagaggattagataaagtttcatgtagctgagctggtcttcaaggatgagcaagacttgggcagctagaaatggagcttaaggggagacaagtttaggcagaatgaattacatgaatagcatgagcaaaagcataagcagaaaaatagaaaacgtgcttggttaaagcagatcagcctgacagatgtaatggaggcaaacaaggctagaaacaagggttggagatatattatggagagctgtgctgtcattttgagtctctgaaagtacttggataaaaatgtcaggatcttagcattatagtaacaccttaagaattgttaattgacatcttagttgagagcaaggtgaagagagaaggcagacacagtacatgaagaactgggagggggacacaacaaacttcccacttcccattattgcccaggaccactcaggtgatcactatcccaccttctgagactccataacagaaaaaagaggctgagtttggctttatttaataagcagtcactttctgtgcaaaggagatgagaaggaaaagtgagaggtaaattggacatctgatgaattatcaagaaattattatgaacagccttgtcaccttactgagctgcaaagaattcattactttcttaaaatgatgcatttaagaaaacacaatgtttatgaacagacatagcatttgctgtggcagcatcaaagctaaagtgttaacccagatcacactttaaggatccttctccctctctcctcccaccctcacactctctcacacgcacacacatacacacacatcactaccactagcactagcatcatgatcaccaccagcactatagccctgttatatcaggaagtttcaaatgtacaaaaggaagaggaagaagagacaatcttcttttttgttttctaaaggtaaacactgcaacatttcaaagatggtccttccagctttacgtaagtatgactaaatgaagcagggatttaaaaaaaattggttatacctgtttctttagatttgagggagggtggtcacttaaaggagcaagaaataaatgaaattattaatagaatttttagtcacctgtactggagtaactacagtttagcaagcaaaaaaaatactgagacatagttaaggaatctacagcttcagtgtgtaatttttttggccagggaaggggtgagggattaggagagtagaggtagctgggagattggctgttaaagttagaaaagtagtgtggatggggaggtggcagccaagccatttctagaagtataactatcgtagtgaattgggctcagggactcatgctacgtgaggccttcagatagacaatgactgacagaaaagttttctatctgcttgtgggaggagtacataagagttaatacttttatagtgctaaccacatgttaggcactattctaattgcttcatgtattttcacttgtttacttttcccattaaccccataaggtaggtactattattaccattcccattctatagaagaaaccgagaaaacatagaggttatgtaacttgcccaaggtcatataactagtaaatatcagagccaggatttgcacccaggcagtctggctcatgtctatggttttaaccactgtgtgtatgcgtgcgtgtgtgtgtgtgtgtgtgagagagagagaggctgtgctcacaaacatatacttctttttcctttagagttgcctctcacgacaatcacaatctctagagttaaccattgcaaatattttgtgtatttccttcctgacttttgaaaaaaaatagtacctgtatagaaatgcataatacaacatattttaaaagcatagacagttcacacacatatatatacacacatatattttgtatgtactttactctatgtctaactaataaaaataatggagacagagcgtgaggacaatctgcttcatatacatgccttaggaatggcattatgccatgtggccattctgtgttgattttggagtcctttctcctcagggaacagacaaccaaacctttatagccttaggcttagttactgtctcccccatattctctttgtaagcaaagtaactgtttattttttatttttttagacggagtcttgctctgttgtccaggctggagtgcagtggcatgatctcggctcaattcaacctccacctcccaagttcaagtgattctccagcctcagcccccaaacccccccaaccccgccgagtagctgggactataggcatgcgccaccattcccggctaatttttgtatttttagtagagatgggtttcatcatgttggccaggctggtctcgaacacctgacctcaagcgatccatccaccttcggcctcctaaagtgctaggattacaggtgtaagccaccaagtaactgtttggaacatggaagaaaaaggtgggagatataacctatgtttttcatctggtattttatgtacatagctataaaattttttgtgaaatgaggcagaaacctcctttctatctcgtcagaaccatgtaattagatcttaaaaagactgaagaaataatcgattcctactccatcacttaagagacagaaatatggggcctagagaggggagaggcttatccagcatcacattgctactaaatgacagggcaaggcttgagccagatcttctgagtcctatccagtgttctttccaatctactgcttgttttgtaaagcatggcacttgcttataaatccctctgaagaaataaaactctctagctctcatccttgtgtatttaccctagaaatatgaacatttatgtccacacaaaaaccttacacgaatggtcataacagctttgtttctattagcaaaaaactggaaacaactgaaatgctcttcaccgtgggcacatataaacaaattgtagaatattcacatagtagaatactacttagtaataaaaaataaaaaactattgatgtacacaacaaattcagtggctctcagggccattatgatgagtgacatagcaaatcacagtattttacatactatatgattccatttacataacattctagaaatgagaaaattatagtaatgatgaacatatcagtggttgctgggggacagatgtgcctataaagaagtagcacaaatgagttttggggggatgataaaacaataatgtcctaattacagtggtgattacaagaatctataaatgtgataagattaatagaactatccaccccccccccaaaaaaagttgagtgcatgcaaaagctggtaaaaatcaaatgaggtctatagtttgctcaatagaattattgtaccaatgacagtttcctagttctgatagttgtgtggttatgtaagatgttaacattagagaaggttagttaaatgtatgtgggaactctctgtattattttagcaacttttatgtaagattaaacttatttttaaaaagaaaaaagaaagaaaactctctagaagtcccataatgttttaggcaggcctggtcaaccaacatttctgtagttttctgaagttctaatatatcttcaggcctttgctcaactggcgttctctctctctctctctctttcacacacacacacacacacacacacacacacacacactcaccccactctgtaacctagtttatttttatccgtaatacttataatccctaataaaaatatgtttgtttattgtgtgtctcctcccattagaatgtaagctccttaagtttaagcactttttgttcactgtatccctaacacctagaatagtgcttgtcacacagtaaatgctcagtaaatatttgttgaatgaatgaatgtgtgtaggcattgaaataaaggtattat

SEQ ID NO: 3600 - DNA, 8970 bp, human
cagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagtgaatatggtgacaagcctcctgcctctgtcactcttccctttacttcttcctttccaccaagaattatgctaaatatgaaaacatgtcagtgggccacaaaatgaaaaaggttaacaaagctgttgtttagctcacatgttacggtttcactttctggtgaattggagcaagacaaaacagagtaggaacttcactcatgccagtcaagaggggatgagctgaaagttcccctcaatgccctgggtgcagtgagggctggggtgagggatggtggaaatggaaacaaaagcaaaattaaagctggattcaagactggaacagattcccaacctaaaataacatctccatagctgcaaattagtattttcttttacttttttgttcctgcttttgtgtctgacttcacaggccagcatgagagtagtttttccaactaaccccttcaaataggcttccttttcctgttttgtgacaaatctggggcagaattctgttttgtaacaaggtggggtggggagatgagaggacatttggggatcaaactctaaaaaacatttgcttcgtgcagctccaacctaaaccacttggcccatgtaactatgttcctgggtgtttcttcagattgtgaagtcacaaactctaatgcttcactgatttatttgtctctcctactctggaaagtcttagcgccaacaactgtgcttctttttcctgatatggggaaagcagtcatctcccaggaattaagaagaagtctgagaagtgacaaagatctaaaggttgtcacctctgttttcaaggttatatagtcctttgtaaagaaaagcttaaaggataattcttaacagtgataggatcatagcatcttagaattggaatggagcttagaagtcatctagtctaatcttcttcccttctaccagacacccagtagataatcatcctgtctctgcttgaacatttccagtgataggtacctcacttctaacaaaacaacccatttgattgttgtgcagctataaataatggccagtgcttccttataaggggcttaactcttccttttagtaaataataacaacaataataatttacatgtgtattatgctttgccatttacaaatgctcccacatacattatctcatttagtccttatgggtgcttacttagccttataaaatgttattaactctactttatagatgaagaaactggggctcaggttgagtgagttgcccaaagtcacagagctacgaaatgagggagtcaaggttgcagcttgagcctgtcagacttcaagtttaatgctccttaaagtaaaccacagcaaccaattagtcctagttctgaacttttgtgcctcactaacaaacctaatccatctttcacataacagttcttcagataattttagttagttcctatgtccttctaaattttctcttttccaggctaggcatcttcctttctttcaattgctcttcatatggcatagtttcagatcttttgttatcctagtatcatttttaagaacacactcctgattatcactgtgctttataaaatgttctgtcaatgaagtgaatgtagtactcccaaagtggtctgagcactgcagaggatagctggattatttctcttgtacattagctgattcccaattgccctgtaccttttttttcagcagccactttgactactgactgtttactgagcatatgatcaactgaattttctatgtattccaaatcctgttcttatacaattgaatgtctaaaacaaaaatacaaagccttgaatttatccctagtacattttatctggttagttctgccacttcatttcagcatgctaaaatcctttgggatacagattctaccttcaaatatacttgcttaccctcacagcctgccttctatttcttcctctagttattgatagaaaattttgttagaacaaggacaagggcagaggcctgaagcaaaattttggatggcaatgagaaactattttactaggaataagtatttttgaagattcaggatcccaatcctacctgccggtctggcctgccacagttgactgaacctccgttctgagagctactttcctttgacgttttttcacattttctttatccagaaatttcatgcttgttggtgaggattattcccccttcaccttttctttcaactttatttcctgatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaaaatcacagaaaactttccaagactagcacaaagaacacccatatattctttacccaaattcacctactgttaatatttgtcccatttcctttagcatttgctaacattccctgttcttttggaaccattttagagcaaattgcatacatcatggtctttcacctctgaattcttcagtgtatatttcctaagaataaggaaattctcttacataaccacagtatagttaccaacttgaagaaatttaacgttgatgcaatacttttatctaaccaccatttatatttcaatttttgacatttgaccaaataatattctttatgacatataaagaacccaatattgtcctttatagtttagggtcaggtattacatttaattgtcgtatctcttttgccatatctcttttaatctggaacatttcttcagcctttctttgtcttgaacaacattgacattttttaaaaagtgttcttttatgtctttattatacttcattatactgttccttattttgattttttctgaagttttctcatgattatatttagcagtacagttctttcttagggtataatatctggagacacatgatgtccacttgcccttcactgatgatgctaattttgatcacctagtcaagatgtcgtctgatttattcactgtagttgctactttttcttttgccactaataaggaatctgtgtggtatgttttaaaaccataaaaataccctgctgcttcatcaaaccatctcatccctacccccacccttgttttattatcagttgatgatacttgcctgaatcaatcattaatatgatgattgcaaaatgatgatttttccagttgagtattccctcccacattttcaagttggcacttggcattctactataagcaagagttccactccccatttcctcccatttgtttatatatcagtatgggctgatgaattatcttttttcaattgttaataattatttacagcccttacttgtgttggtgttcaaattgtcaagatttagccattgggagcctttcaaggtgatttctgggtccttataatattcccccatcattttcttgagcacttccttactttctggcataacaaaatgttctaggctcattttgaccttattctgtcccagccttgaaatcagtcattattttccaagaaaccctggtttcttttagtgggacaatattagagaccaagacctgagtgctagatatgctagatataaacacaaatatccatacatgtaagcatatgcacacatatataataacacatgcatacatactttatatatgtgcatatttatgtgcacatacacaaacatatatatattttagaaatcatgagtttacaccaataccttaaattccagtccatccccacaggttccttcctgcctttctccattctgtatttgtatgttccttcttccacagtatgaaccctggctcccaacatcaacacatgtactcatttgctcaatcccataatacatctaaaatagtttctgaattgctctgtccacgccacaacaaaaacaaactggctaacaatacttcaggatttgtttgaggttttcctcccacccccactacattgatgtaattatgctgttcgtctgaaatgcagttgggtttgtttcagtttgccttcagctttagtccccaattttcccatctgtattcatttaattttatttttttgaatttgtaaaacaatgtgtttcccaaagaggatgctatacaaaaaggtacattcagagaaatgtcatttcctcccacatccttttaatcctgttcctccaccccctaccccttgtggataaccaacttcatgaattttttatttatctttcctgtttttattgttgttgctttgtaaatccaagcaaatatatggatgttttcttatttttctttctctcaaaaaagtagtgtactgcatatatactacatatacatatatacttttggaatttgcttttttcaattgacaatatttccttgaaatcactctatatcagttcatagtgatcttttcctcatttttttcacagctgcatagtacttcattgtgaagtttgtctttgtattgttgggtgtgtatctggagattatatgttttcctctttgtattaaaatcttatgtgcagcttgtgattcatactgtgtattggtaacataggcaaggcctcaaacattgctcctacccttttaatccatattgtcttttcattagaatcactgggcacctccaccaattcttcctcctctttctcctgcatatctgtttgccctccatcgtttcttttactagttttaacttaggctcttcaacttcctctcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaagagttggtacacataatggttatcccttttatctggaaatccaaaactttcctagaactttcccctgctctgtctgacttctgcttccatctgcttccatgttcttagccgcccctagcagtaagggaggctggaagattgagtatttagcttttccggcctctatagtgaaagtgagtaagagagaaaaagttgggaaagggtaatgtgttagccaacagtgtctgtcacagaagcattctgtataaaaatctcttgccacacccagcaactggtccctcagtaacaatgcctttgtcatatggttataaagaattatctgttgtgaatgatcctacacaataaatgttttctctgatcattgatgatgcaacagtcactctaacaaaattgcctaattatatgttatttacatcccaattgtaagagggcaaaaataattgttcagttgctgagttctcagggttttccggttctgccatcaagcagcaattacatcaattcccctcacctcagacatcataacactctttctgttaaaatctacccaaatcccaaacaacccactgaaattaagcaaagtacaaaacatatttgagaacatgaaactttgagcactcccttttactttgataatatatgatgtgggggacagcttattagctcctctttgcttggaatatgacttccctcaaattgcttttaggagagatccacattttttcccacagtgggaaaataaacgccgttatgaaggtcgttttatgggagattggcctttattcttattttattgaaaactctggtttctggcctgttttcttaataaaatttaaacagcagccaacttgcactggaccaagagtgatcatgttatcgagcataccctgccagtgatgatgctggtggaaaaggtagaattttaagatacttcatagtgctttttcttttttttttttctacttatttttcaggccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatact

SEQ ID NO: 3601 - DNA, 100779 bp, human; identical to SEQ ID NO: 3597

SEQ ID NO: 3602 - DNA, 101314 bp, human; identical to SEQ ID NO: 3598

SEQ ID NO: 3603 - DNA, 34214 bp, human
aagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtaaggaaaggatctccaaaccaccaaatataattggaaacagagtttccttttaaataaaaattccacatttttacatagaattttcatctcctgtacttcaaatgaattgtgattagtatgatgagttaattttcagaactcttgcttagcaaacatatgccatgctgatatattaggggtgtaagcccataatattattgttttatggagcttctgaatgaaaattttctcagaaaaaaatatagtttattactttacttactttgaaaagtgaaaaaaatgaatttactcagaaaccaaactttgtgctagggataattttgtctctgttttacttactttagtgtttcctttaagctcagtgattgacttgctctagcaggcagagcctgggttggagggcctgccctggcttacatatgggaagaacagaaatttactgagtactttactgtctaatatttcttaaggagttgtggttttccaatcctaagactgtattttgcaaaatatgtgagtgatttatggtgcacaacatgggtgattttaggtatctgaacagaagaaaatcaattttggaatcaaaatactgatgttagttagatccaggagagatcattaattccaaaaatcccttgggtagttttcaaatatcagatacattttgcatctgttcttataagttaggtccatagtaaatacaataatattgtttatccaaaaacaggattttcaagccattagtaatattaggcagtggttagaatgaggtttactaggcgtattaatgacataagaaaatacccacgataaaatattaagtgaaaaagcaggatgcacacatatgcctagaataaattactagaaggttatataccgaagtgctcatggtggttgcctctgggtgatgggattatagatgattttaattttatttcccagcttttcatacttcctgggttttctacgaagaacattatgctatttttataattagaaaaaagtgttacttttcaaagtgatctcatgtttagaaatagttctttaaatgttcattactaaatgtttaagcatagatgttttatggagttaaacatcaccagaaggcaatactccatttgtccagtgacctaactaggccctagagctggaaacacatgttcctattttcccttctccccaggcatattcatttaaatgtaactttagatatggaagttttgtctcttcttaaagggtttccagtcattagccagttgggtcgacccctgggccttctgcatcagccctctaagatcatacctgtttccctatgtgaagccttgccctggcccatactaggcacagggtttggaacggttgttaagaacagttttttttttttttaactgtacctaacatacaagtaatttttactgattataaatgtaatgcatggtcattgtagaaaggttggaaatatggaaatttaaaataaaataaaaatcatctgcaattttaccactcagatttgggtgaattattattcttttatttgcaggtgtatatattacattttaaaaattgggtttattccttgtatacttttttattgtttaaaaaaattgtttagcatcatgtcaggattttattttattgtgacttttagaacaagaccaataaatacttcagagtgtgtttcctaagttactatataactgattttgttggtatatagtgtacactatatatctacacacatattatctagttggcccaaagcagtagtgtcagtacagcaaattgtggtatgctctattgtcgtttgctgtgcttacatatgtattgaagtcagagaaaggatcactttagtaatctacacctgtcattagcagtgttcatcagttgatctggacaactgatagtgtttccatcaatgtgcaatttgatgttcttcctggacttgttttggagagaatgtcactttttggtgttaagcgtggtgcctaacacatagtggatgcatagtaaatgtttgttgaaagaatgaattactttcccaaattccaaacatccagacatcattttcacatacatatttaaaattgattttgatataactaaacaggtcagattttgcttaaatcaaaatattttcaatgacttcttaggaattcttaggttaaattctaattcaggaaaacgagttttaatcaaacttctgcaaaaaatttatgcatatcattttaggtatttgaaatatgtattagtcacctcttagaaagatatgttaatgtgggtttcattttctggaggtatatgctatgcattttaaaggagtaatatatttgaactttgagtttgcactcaaatccaaaaaagtgagtgatcatttgattatattatttcctaagtcaaaatgaatctattatatatgaagttgctggaaattaaatcacttcaaatctatcagattaaatatgaatatttgggggatattttgctgtggtacattaggaggataataatccttctataagcaaaatgtttgccaccttgtaggcattaaatgaatgaacaatcaccaccaaaatacaagacattctctctctctctctctctctctctctatatatatatatatatacatatatatatacatatatatacacatatatatatacatatatatatacacatatatatatacacatatatatatatacacacatatatatatatacacatatatatatacacatatatatatatacacatatatatatatatatacacacacatatatatatatatatatatatatatatatatatatatatacacatatatatattcttttgagacgaagttaagtcttgttgcccaggctggagtgcaatggcacgatctcggcccaccgcaacttccgccttccgggttcaagtgattctactgcctcagcctcctgagtagctgggattacaggcatgcaccaccacgcccggctaattttgtatttttggtagagacagggtttctccatgttggtcaggctggtcttgaactcccaacctcaggcgacccgcccacctcagcctcccaaagtgttgggattacaggcgtgagccactgcgcccagcctaaaaatatttttaaatgttgattaagtgtgtacatcttggattatttttctttaataataagcacttttttaattattattatactttaagttttaggatacatgtgcacaacgtgcaggtaagcactggtttttaaaagagattacacatatttcaaccacatatgcatttttgttttgtttttaaatttggtcaagtcagagagggacattgcgttcttgggttttgtttaaatcagatactaatctttactttgctatttattcacagtcctattgatgtagagatttttctgacttattcaatttttaaataatttctcaacttagaatgacttaatccaaaggaagggaacttttttccctgacactcagagaatcacctccactttaggactaagtttgcactgcccattgtctacatgtggctattgaaatttaaatcacttcagattaatgaaaattataaagtcagttcctcagtttcactagccacatttcaagtgtttgataattctatttgggctactgaactggatggcgcagagatagaacatttccatcatcacaggaagttctgttggacagcactgtaagggtgagctcagaggttttaagtaatgtgcactaattgaatgatgtgacattttaaaaaggctcatctggaaatatataacttttagctctgaagcatatcatcactatatcatggttggacaatgtctgaaaaacatcttttcttcagaatttaattggttatggtgctaagaattgggaatctgggcaataaaatggcctggaggttttgctttgccaactgttacttatttacatgacaatgtgtagtacctcaaaaaatattgtctcactttaaaatttgaaattaccatcctaattccaaggtgatattattaaacttttgcagatttctaattagttacacatttatatatcttctatatttaaaatgttagaaatgtttgaatcagatttatattttccaaatccttgattttcattcacctctattctcatctgtgctataaatggcttcctgctgcactgagggatggcagagattgtgtctgtcatgttcattcttgtttccccagtgttcagcactgtttgtggcacaaaatgggtgctcaattgatatttgttgctaggctccacagcctcttccatggcttgacttgtgtgagtactgtgtgtactctgccatcaaacactttttccaagagtggtcttcaaagggggtttgtggggttttgtttattgttttgccttatctgttcataaattctcacccttaaccaatctcgtaacagatactgggtcccaaactagagaacaaaaattatggccaaataatatctctaaaatctctgtttttagggaataagtctgggaactttaagggctaccaaaaccccagttttatcctttttattttggacactttaaagacatttggaagtcatcatttaagcacggccagagatgtggctaacttccaggagaaatgaaatgggctctttgagggtgggagggaaccatctttctccagtgaagtttttgttggaaagattagctgctttctgaaagccaatttcctttttggaggaggcattatggaaaccaggaaagcatggggaggagaatattgggaagagggaaactgtatggagttaaaaagtgctgcatttttgtttgcattcaggcacttttcttaatttatcagtgcattggttgccatgtaaacagccagcttctggcaggaaagcagctggaccaggtgacctggctgtgacagagaacacagatattgaatccatgaaaccaagagtaatcagtacaacgattttttttcttttactttttaaaagtgtttgtcaatcctttaagttctttttgtctgactgctgtcattaagtaagaaaaatatgaaataaataagtctttgggtatgcaaaattgggaagatggacaggaattagtccctctatgcaatttcctctgaatctttcataatttctgtatcctcatcccttcaccctcaaccctccaacaccctctgttaccctgcaggcaactaggacagcatagagagcgtctcttgaacttgactttctcttccagtgcttgcctgccaatcccgtgacccatcctggagaacttttatagtcttcgacaatgcaatgcatagcaaccagttaataagataagacagtgactgtatagtgctccccaaagtgccatcacctaaaatagccctttggaaagtgctcatatagaactgagaattttagtgtagtggcaggctggatttgggtagggtgcccttcggtgggcctccaaatcctatggggagcttaattacttcatctttctgtaaggccaacagttctcaaaatttgtggtctcaggacaattttacactcttaaaaactgagggagatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtaagcttactcctccctcagagtccctctgacaacatcaggtaggcccaacaccacaggtaaggggggatcttcagaaaccccaccaacaacagtggacaaaagaagcatttgccttctccccaggcctgagatgtcccactttcacctagagatatcgaggtgggagggtagaacagacacgaggcataaagtgatggcaagcggcccagtctgggaaggctctgtctcagtgggtgtatgactgtcctctcctacccatagagacaccaacagtgcagggcgccagtagaagtgtcccaccatacctaccccaactgagaggcacctggaagcctgacctagggaaacctttctgctccttcaggcgatatgatctgggacaaatgtcagcctcagtgatatccgataaaccaaacagagcaaaacaatactgaaaattaaactgctgttagaacaacagaccacaaaagtaagccaacacctgcttgcatgtgaagcataaataatgtgactgactgcaaaaataaaaaatgtaaatatgagtttcctaacatagtagacaaaatgttcaatcaaaaatcatctgtcataccaagaatcaagtaaatcacaacttgactgagaaaaggcaactactgccaacattaagatgagttcgatgttggaattatctgacaaggatttcaaagtagccatcataaaaatgcctcaacaatcaattaacattatcttaaaacaaataaagaaaaaaaaggaaacttgcagaaaagaaaaagaagttataaaaatataagaaagaaggaaattctgtcatttgctacagcatgaatgaacctgggggacattatgctaagtgaagcaagccagacacagaaagacaaacaccacataatctcacttatatgtgagatctaaaagagttgaactcagaattagagtagaatggttaccagggactgtggcttggagggagtgggaaatggggagaagttgaccaaagggtacaaagttccagttagacaagaggaataagtttttaagacctattttgcagcatgctcaccatagttgataataatgtatgtgcatttcaaaactgctaaaagcataagattttagtctacacattgggtacagtgtacactgttcgggtaatgggggcaccaaaatctcagaaatcaccactaatgaacttatccacgtaaccaaacatcacctgttccccaaaaaagtattcaaaaaaataatagattttaaatgttcctgctatgaaaaaaacaaaacgaaacaaaagataggtaggccagatgtggtggctcatgcctgtaatcccgccactttgggaggccaaggaaggtggatcacttgagctcaggatttcgagaagagcctgggccacgtggtgaaaccctatttctaccaaaaatacacacacacacacacacacaaaattagctgggcatggtggcatgtgcctgtggtcctagctactcgggatgctgagatgggagaattgcttaagcctgggaggcagaggttgccgtgagccgagatcacactactgcactccaacctgggtgacagagtgagaccctgtctgaaaacaaaacaaaacagaacaaaaaacaaaaaaaaggataaattacgtgaggtgatggatatgttaattagctcgatgtaattattccacagtgtatgcatatattaaaatatcacattgtatcccataaatatatgcaataattatttgttaattaattaaaataaaaattaagttaaaaacaagaatttaaaaaatacatactttgcaattatctactatttttctaaagacccttacaatctataggctctttctcagttttcttttttcccccttggaattattttttgaataaaactggcttgtttgtcccctccccccaaaaaacaaatataaattatagaactgtaaaataaaataacaaaaatgaaaaactggctgatggactcaatagaagagcagagatgacagaaaatagaatccatatctggtgaaactatccttcaggaattaaggggaaataattaaattctcagttgaaggaaaacaaaaagatttgttgctagcagacatactgttaaaaaatagctaaagggatttcttcaaacagagaataaatgataaagagcaatcaggaaggatgaaaggacaacagaaagagcagaaatgtaagtacataaagtagactatcttttaactcatgagttctataaatcatatttgataattgaagcaaaattataacaccattttatactctagacaatgatatttaaaagtggggaaggtaaaggaaactaaatggaagtgaggtttatacacttcaatcaaagtggtaaaatattgatatgagtagactgttatgactcacacatgaatgttgaatacccagagaaaccactgggaaaactctacaaagatatatattttaaaacactatgaataagtcaagatggaatcataaaaaatgctcaagtaactatcagaaaagcaagaaaagggaaacagaagaataagaactaaagggaacaaacaaaaaacaaataataaaatagcaaacaagaataatatatcaataattacattaaataattatattgaatgcgaataccactacagtagtccccttttatctgtggttttactttctgaggtttcagttacccatagtacagtataataagatattttgtgagaaagagtgtgagtgtgtgaacacaatcacataatttttactccagtacattggtataattgttctatttattagtagttatcattgttaatctcttactgtgcctaatttataaattaaactttatcataggtttgtgtgtatgggggaaaaatatatatagtatacatagagttcagtactatccatggtttcaggcatccactgggggtcttggaatatatctccctggaataagggggaactactctatatgctattcacaagaaactcacattaaatttgatgacataggaagattgcaagtaaaaatatagaaaaagatgtaccacataagtattaatttttcaaaaatctggagaagcttcattaatatctgataaaatagtcttcagagcaaagaaagttaaaagagataaacagagacattacctaatgataaatggatcaatccagcaggaggatacaatgatccttaatgggtacacaccaaacaactatgtctcaaaattcatgaacaaaaactgatcaagctaaaagaagaaagagacaaatccacaattatagttgggaaattcaataccccctctcagaaattgataaatctactagacagaacatcagtaaatatagggaagatctgaaaaagacagtcaattaacaggatccagttgaatatttttacgattttatattggtttttccatagtggttttaaattatatctctttgtatagaaaactccacccaacaacagcagaacacacttttttttggcacctacagaacattcaccaagatagataatgtgcttggccgtaaaacaaacctaaacaaatttaaaataattgaaatcatacagagtatattctctgactacaatgcaatgaaactagaaatctgtagcagaaaagtatctaaacacgtggaaattaaacaacactgttctaaataatccgtggatcaaagaggaaatctcaaaaggaatttttttaaaaatgcgtagaactgaatgcaaatgaaaacacaacatattgaaatatgtaccatgtagataaagcaattctgagagagaaatttctaacactaaatgtttacattggaaataaaggaaggtcttaagtcaataacctaaatttctacatcaaggatctagaaaagaagaccaaaataaacccaaagcaagcagaaggaagggaataataaagagctgaaatcaatgaatttgaaatagaaaaactatagggaaaaattaataacacaaaaatttgcttttctgaaaaaaaaatcagtaaaactgacaaacttctagcaagactaataaaaagagttaagacccaaatcactaatatcagaaatgaaatatggaatatcactatagatcctgcagtcattaaaaatataatgagagaatattatgaacaattatacattcatatatttgacaacttagaaaaaaattggccaatttatccaaagcagcaaactactagaactcacccaatatgaaatggataatctgaatagctctataaccattaaagaaattgaattcataattttaaaagctcctacaaaataaatctccaggcctagatagcttcagcaaataattctagcaaacatttaaagaattattaagatcagttttacacattctcttccaaaaaatagaacaggaggaaacacttccaactcattttatgaggccagtattatcctgataccaaaaccagacaaaaacagtacaaaaatagaaaactacaggccaatatctctctcatgaactttgacacaaaaatccttagcaaaacactagcaaattgaatccaacaatgtatgaaaagaattatacaccatgaccaaatgggatttatttcaggtttgtaaggctggttcaacattcaaaaagcattcagtgtaatccaccatatcaacaggctaaagaaaaaaaaatatgatcatatcaactgatgcagataaagcatttgacaaaatccaatacccattcatcattaaaactcagcaagttaggaatagagggtgtatttgtttcccagagcagctgtaacaaattgccacaaatggggtggcttaaagcaagagaaattaattctctcacagttctggaggccaaatgttttaaatcaaactgttggtttcttctgaggtctctgaaggagaatctgtgccataagtctctcttagatggctgctggcaattctcggtattctttggcttatagatgcatcattccagtctctgcttctgtcttcacagagcctttccctttgtgagtctctgtgttaagcctccctctccgttttcttataaggacaacagtcattgaatttagggtctgctctaaatcagtgattatctcatctcaggatccttaattacatctgcaaaaaccctatttctaaataaggtcacattcacatatactggaggttagaaattgaacttatctttttgagggacacaatttaaccccctacagaggagaattgcctcaacttgataaaaacacctacaagtaacctacagccaacattatacttcatggtgaaagactgaacgcttttgccctatgattggaaacaatgcaaggatgtccactctcatctctcttattcaacatagtactggaagttgtagccactgcaattaggcaataaaaataaataaaaggcctacaaattggaaatgaagaaataaaactctctatccccaaaagatttgcatctagattatatagagaactctcaaaactcaatcattaaaaaactaaacaatccaattagaaaatgagcaaaggatataaacagatattttgctgaagatgtacaaatggcaaataatcccattaaaagatatttagcatcgttatctatttgagaaatgcaaattaaaaccacgatgattatattacttcatacctgccagaatggctagagtagaaaactgtgacaacaccaaatgctggtaaggatgcaggaaaacggaatccttttatttggtggtggtgaggggaatgtataaaggtacagtcattctggaaaacagcctggctggttttttaaaataaaataaaatatgcaactggcgtatgatccagcaattgcactgttgggcatttgtgccagagaaataaaaatttatgttcatgcaaatctgtacctgaatgttcactggagttttatccaatacccaaaaactagaaacagcccagatgtccttaaatggatgaatggttaaacaaactgtattacatatatatcatcgggtactacaaatcaataaaaaacaacaaactactgatacacacagcaacttgggtgaaattttagataattatgctgagtaaaaagagtcatcaattccaaaaggttaccatgattccttgtatataacatttatgaagtgacagaattttagaaatgaaagacagattagtggttgtccatggttaggacaggaatgaggtgcaggatggaggtgagtgtgattataaaaatgtcaacatgagaggtctttgtggtgatggaactgttcaatatcttgactgtggtggtaaatacacgaatctacacatgataaaatagagaattaaatgtgcatgtgcacacacacagcagtacatgtaaaactggagaaatatgaataaggtcgataggttttatcaatgtcagtatcctggttgtgatattataccaccatcttgcagaatgctaccattgctgggaactgggtaaagtgtacatgagatctgtcttatttcctagaactgcatgtgaatctacaaatatataaataaaaattttaattaaaaattatcgaggaccccaaaaagaaactgatatgttttgcctgagatttacctgattttaaaactataagtcccacattcaaggaattcccatggtactgggaaaactgagtcagttgttctctatactaccagacagttttgggtccctggacaagactttaagaacctgtgtaaggccgcccttaacacagaagaaattctcagttcagtgttattaccacaccatcatctagaatttgagtatcttcatatgataatttgttagaaactctcctcccactaccccagtgagccccaagaaaactcaactttcttgtatggtttattctaccttcttcccctcaccttggattcctcaaataggatgtctttgtaagtgttctgtgatgaaacagtgttatcagaatttgagtatgtactattgatttttttatgattatcttttcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctgtaaggacactttttcctaaactcttccccttttgtagttctgactgaaaactgttggggtagaaaaaatgtgaaatgtgaaagaatggcatgccagtgacagtagtggcaggaatctcagatacaaaaagtttgaagacagctgtatagagaagatcatcatctaagtgacttgactcttgtcctctcttcatatttagttataacccattatctcggtctgtgtaggtccacatcaagtggatcatgtattttagagaagacagaaatggttcttctcataggtgaaattaatagtaattctgaaagggctccccctccacctttatctccctattatttccagaagaaactagttcaaatgcaagtcctgattgatctgcagatctctgccaaatttaatatctaggatctggctgtcaagtgaactagctcactgtgctagactgaggcctgacagaatgagactcttcagatggatgaagaagggccatagtagtgatgaaccctgcgtagttcatcaagaacagcatgaggatagaggacaggggatggagtgggtaggcatagggtcagggggaagaggttgccagaaaaggatgggttgaaagtcaagggaggagaatgatttcacatgcaagctgcctattcccaggtttccttcatcaggccttgagggaaattccttctttagcccaaagattcaaattgtatactcaaaggtgtgtgtgtgtgtgtgtgtgtgtgtgcgcatgcatatgcacgtgcgtgtgtgtgtttgtgtgttcatgcacatgtttatgtgagcacatatgccatgcatgcctacacatatcccttgatggaaaaggtctgtagctttcatcaggttctcaaaaggctgcatgacccaaagcagagtttagagaagagacaagtcggtgtggtttggaatagttggatgcagctgaattgggccttgaaggaaaagaaaggttttgattagtagaaagatagagggagagcaagttgaggaggctgggggaggcctagggacaggggtggagaagaaagaaggcattagtttagaggagccacacgttggccagtgtcacttcagccatcactagtccttcagaagtgctgagtcctctgtttacaaatcctgagcatttgtttagcaggaaatgccgtacagggggagattccatcaatgccactctctagtccaagttaaacaattttgctcaatactggttaccttggacaagtatctgaatcactctgcacctctctttaaaatatggtagatcagcaatacccatggggaatcaactgatataatgcatgtgaaaaatataaagctctgtaagttttatcccttgtaaacactattatgattatcatcatccacagcagcaccaccaccaacagtgcttctaccagtttccatcacccaagatgtccagacccaaggccttgtatgtaggagtcaactaagaaattattgccttcttttgcaggatgctctgttagattgtagatggcaataatcacatgacctttcttcctttttgaaattcaatttccggactagtcttgtcaacacattctttatctgtaggcttgaaatccttctcattttgccaggtggggctggatttagggagaccttgccaatgtattttgaaatattttctgcttgatattcaaatcaagatgttctcaactgcctgaaggatgggcaaggccacaaatttttatttatgcctcctctgacactgggatttacaaggctacctcttggttgaactgtgtgtctagtgaggaactgggagggagctgcagagccgaaggatcctgtgaccagcaatgagctttttctataccaggaaatgcaagggaagaagatatggtgattgaattgagtgtggcctgagcccagaacatctcttagaagcacttttaaaaaaaaatctgttaacaaataaatatttattgagtagcttatttacttgccatttgcttcattcttcaaaatgtcaggtacaggtggggcaagtgatttaagatatatactcttttggaatgtccacatcaaaggagggcctctgcactgagctgctggatcaggcaaaacatgctctctgatcttaaagctgcatgatacctgtgttacgcctgtgccttagctgcatagaagacaagcttttgtgtttttattgctcccacagcttgggagcaataacaaccatccccctaaaggcaaattttatcctccttctattttcctgtctttctttagcttaccctagccagatccccattacaaccatttttagctctctacttctaaagaaccggagtccttcccctgactccccatatcctgctggcatgggcttctcactgctttaccagatgagtagttttgaagtcctagtggaaatctcatgatgaatgtcaattcttcttgctctgccacttatttattgactgcgtgatcttagacaagtcgtttgacctttcagttgttccgtttccaatctttaaaatggggctacttacctatctcataggttgaatatgaagactaaatgggatgatgcttgtgaagcactacgaagccttctacccagtaagcattcagtgaatgcgagcttttattattggcatcatcacttacaaaatggcgattttgcaaaatccctgttccctccatacccctggtgatctagagggactgactcatgggcactagggagcctagctcaagaagatacacttgaacagggacagagctcttcagggccatactagcccaagatcagcttcgagttccactgcttaccaggtcactgtggctaaagggagggcccaggccctttctctacctgcttcttatccctgaactgacagcctgctcaaccaagaggttgcagacatcctgtgttgaggtggtatttttcaaaatgggatttggcctccatttcaagactgtttcctctttgaaaacattcaaaattctgtggagcatgttgtatgttaatctagggattgctggtggaacatttatgggaggataaaaagactgctgcactattagacaattatgtgatttatgggactaagatgttgccagacatcagtggtcacactgagagattcagttcaactcctgggttgatgtggcagtatactgtatagcattcagctctcagatccacccatttctgctcaaacacagcacagctcgtgcctcagtactgagggtatggaggaaaaggcagtcagtcagtgtctaaaaatgacgcacgcaagagacgctcggggaagatgtagctggacctctgaggtaagaacacttattggtgtactactggacttcttcattgtttggagactccagggcactggcaccagctttaggaatgggatgggagggtctgactttggtaacaatcaagatcagcacaagcccctgacaaaactgggacagtcttgagtttaccttctcacatccatgtctggagttcttctgcctcttcctaaaggctcaggaccctattgctgccctgatcagggcagtggccagctctttccatagtcccatcttccctttcctgaaatcattgtgttagattagcaattgactctgaggcctggtattcctcaatacctaggggctgatgttatctcttactgactatcccctttggagaacagagactgaagtatcccacaggtcttcccaccaagaaggccaggatattcattagcatggtccttctctcagagaaacattcctctcagaaaatatgaacagctttagatagtcaatccctcagcagggaatctcagctgaaaactctaggccaggtatgggcaggctaacatggaaatttggggtggtctggtgcctttctggtcacacagatggcttcatcttccatccagtctgttaatgctaacactacagagaccccacctgtccctgaacagaccatgccttgactctgcttagcatgaatctctcagacaatacttattcttcaagaatgttcatagtgaaaaaataccctttgccagtctcataaacaacttagacaacttctttcccaggacctagtgttcttatgttctctggcttctcaggttttacaacctgaaatacacaggacagagccacacaataaagagttgtctgcccaaaatgccagtgtcacccctactgagaaatactgcaagttcttccccaccccaccatcaaatttatgtattgtgtcccattcactttctgctaaatctgataaattaatctcatggtaaggtgttagggactagcgaaagcttattttattctcttctaaagaatgcattgaatgggaccttccatgccttcttccaaaaggagcaactcaaatggcagatacccaggcaaatggagggttggtaagagagttggtttggaagcaagagagtctttcttttggtatcccattccttccacatgccatccctgcaccacaatacagtccaaataaaattctgagcttgtgaccattgccaccttatacctgcacaccccttccctatcctatggctagcccctctatcagcagtacaagaaagcaagaagctggaaaggaaagaatgggtggtttgctgtggatgtccatgtcctccaccttcccagaaggaatctgcaaaagcagctctggaagctaactccaactcagattcaaacagaaagcagactgaattctttcaacccttcttgtttatactccatgcttctagttagagagcagtgtcactaagctgaggaaaaagtcttttaggacaaatctggttcccagctgcacggccttgtgtgaataggaacttggcacagtaggaagggaaaggttgctctgcaaagaactgaggggcctacaattgcagctggcaaatattgagggcatcatgtggtgaacatactcagcatgggaagcatcatgccaataaatagcaacaattggcaggagaaaggttgggctggagcagggaatggaatggtcccaaaaggagaaggttgcccaggaatcatctttctcatcttaagaagcactgtgagtgccatcttaatatattcagtgggaatcagaaggtctgaattccaggtctgactgtaaattgtgtgaccttgggaaaatggctccctctattgaggcctcggtgtcctttttttgtattagaaaaggatgaattcgagtttactaaccgcaggcctctgggtcagatttggccagtggatgtatttcagtcggcctgcccagtattttgtttgtttgtttcaacagttcgaatgccttgtttgcgttgacttttccgttccctgcagtccccatatctgttatgagcttaccactacttaccagcccctcccagccatttcccatatttccaatatccatcgggctcctgaaggccccttaaccttagaaaccacaaaccaaactatctcacagaggtcttataattaatgtgcaattatgactccacccatcagcctctagcgtcaccctgggggcaggcagagaggaccttgggagaaagcagggcagtctaccatgaacccaagcacaaagtgcaggtgggtaaaaaattaacaagcgccccttaagggaacactgggatggatttccttaaaaaaatcacctcctccccacctccacccaaagatgtggcccattgtacatccggggctttttctggatctccattgctttgacgtctaaattgataatattctttctttgaaaagtgtacaagccacacaggatcatgggccaggctttggccactgttcagctttgatttttaaaagagttattcttttatggaaagtggaatcaagttgtagcccttcctatatgattagataagcagtttcaggaaaacacttctttctttttttctttacaaggacagtgtgactgtgtggacttccccttaacagaaagcccctccatgtatgtgtctggctgctgctgtctacccctaggtactttacttcttacagagaactgtgaagccaaagccttggctcttttaggtctccattgttagccctcactacccccatttctgtctctaataccttttagtgtcaatcgtgagagggcaaaatgtattagactacagcatgaggagctagcatgtaagaggtagtaaaggtctttttcatgggtaaggttccagggcctcattgcttatatactcatttcaccttgactcatgcccaactatgggacttttacagtgggcatggacacatggatacagtggacacttttacttcttctcatatcctaattctggcctaaaacacaccattttggcctcaagatctctgcagaaataaggtccttttcacctggatcctctgggacttgctgtgggcctcaggcgtgactgatgttgtatctcattgtgatgtcatcaagcatcagtataaaacagggctgatgttttacactgtccacagtctccttgggaggaggggaagtggccagatgttgaggctgtgaagggcactcttgatggacagcaggctgaactccaggtaagaaacaacaagacctcaaactgtcaattagaaagtaaataagccccatgctgcctagtgaaattgaaagcctgatagcgtgggtgccaactcaaatgaaagtaatcctctgatgtattgaacctccttctgtcccacttgaatacctggagttaatcctggctttctggtttggaagtcaaacaagaccattctggggcaagagtttgtgatttcagtaggtgtgaatgaatgaattataaatggctgcatttataatgcaagcaagaaaacacgttgatgttagaaaaaacgggagagaaacaaatagttttctctgtaaatgtactcttttcctgggatttttccctcaaaatccagctttctgccttagttttaaaatatattgactttctgcttaaaggagaatacatttgaattcatctagacaatatcttttggttttctaattgctttccctcttttattggcctgttaaggtaaagcccacagtacaaggaattaggaaaattggattccagatctgtctcaaccgtcaattttgccttttattttttaacctctctgggctttggtttcttctgtaaactgagggaagtgaattaaatgaactgtaaggccttccagtagattttatgaaaaattagtctcaccagactaagacaatacagtttattgaacaataacaatcacttgaataatatacatttacatgaaaccaacaaaacatgtacatagaaggtgtgtattatgaagggacctcaggaattacctaatccagtgatttcccagcttcagtcattcatgtaccatctacatgatttttgtcatatttgtgtatcaccagcactatttgttatttaatgttattttctgtattgacttgttttcttaaaatcttaaaaaatatctaccttaatctaccctatgcaacaatattcaggaagtcatagatttaatgtgctagatttttctgtttctaatacacattgaaatttgtaagttttcatttatatactacctaaaatcaacttaaatgcctatacttggtaaatacatatcatactttggaaaacattactctcttttctcattcagatgtggaaagtaaaggttggagagattaaataactttgtttcttatctaaaaccaggctgccatggaggcatgactagaggccacctcccctaactatatcacagtgaggggcagagctgtgactaactcaagccacctgacccctagaccaggaccctttccaccacatcatgctgctcccacagttgccattatgatctaagtatctatgctctttaatagaaatgggactagaatccagatcttaagtttaataagttataataataataaatgagcccttgtggcttcagatgggtcacttaatctctctgggtctgagatgccttatttgtttaaatgacagaagaattccagttctgccttctgccacatggggagaaagatggtagctatcattggctgagcacttccgaggtcctttactagatttcttagtttcatcttcacaacaccactataaagggatgggaccagatgatttctaagatgcttttccgctttgcttctaataaacaaaacaaacccaagtttgtctatccaaaagagtaggtgtgtctaaaaggagcatgaacatttgaacatttaaggaaaccagatagtctcactgggtaaggtaaattcaaattttaagaagtttataaaatggtaaaaaaaaaaaaatgatggttttggtttcccatcagacatttgtgttctacataatgagtttctctcaggtggattcattaagtgagcatcttgatctcctagcccaagcttaggtgttgaatcctgtcagctccagctgcctcctcctctgtaagataggcatactaatccctgccctgatgacatcacagagctgctctgagggccaaatgcgcagctgtgagcaaactaaagtgccccactgagttgagaaaccttggccacagggacctgttcctggtggggggaagatgctgcttctttatcaaaggtaatgtgtttagaagaagctttcaggtagcttatcctagtcctggactctctccagttctcacttctgttatttttctgtctagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttaggtatgagcacttttttctgctttttcttttcttggaaaaagttaggacactgaatgagccaggacagtgagttatgatgccaattaagtctctgtaggtaaatatactccctaatattttcattatcagggaaatagagacaagccaccagcccaaccaaaacagtaacactgagaaatcactcataaaacatgcagaacaattgtgcaaacgggctgccaaaatgacagcagtagatgacccaacctccagtgatccctatctctgagggatggaatgagaacagatgagacaatccactgtcccacaaaatgatcactagcaactcttttagaggaaacctccatttacagccagatctacctgggggagactactgtcaacttattattccttttaagctcgacacaattcccaccattaaattattcttttaaataaagacaggagagtcccttttttaaaatgctaatgttatttggaaaaaggactgaaattaatctagtgttgagaatcaacatatttacatacaaatattcattatatgatattgggcaagccgtatctgctcttaaaatgaatttggaatctcatttgttcagtatttattgagttacagtgatggaggtgttgtttttgcccttgggaagctcccaattttggccatttctagaagtccttacaatctctgtctgagaggacaatgtgggctaaacttccatctgcaggctggtattgggaagtatcgaagcaagggatgaaagggctgccaatcctcaactcttacagacagaccagttgagatgagcattttcccacttctaggtagccccaaatgaagctgatctagtcattgctgctctcaagctgtgtgcacacatcacaagaaaggaggaactacatcaaatcagtgacttaatagttgagtagcttggaaaagcagcaattggtaacaaggtgcatacccaagagaactgtttacagttgtcctggcttgccactcaggtaatgccacaaaggaaccagctgacatttactgtgaggtttgccactgcatctacccacctgggaaagagggaaaggtacctaagagctattttttaagagtgggttagcttaatcaatcatatttttatcttactgagttctgtgccaggaattggggtacaggaacagacaagagaagtattactcaagcaaattcctgggagagtttctgtttcagtttggaagactagtgtattagtctattcttgcattgctgtaaagaaatacctgagactgggtaatttataagtaaaagaggtttaattgtctcacggttctgcaggctgtacaggaagcatagcagcttcttgggaagcctcaggaaactacaatcatggcagaaagcaaaggggaggcaagatgtctcacatggctggaacaggaggaaggggaggggaagatgccacacacttttaaacaaccaggtcttatgagcactcattcactatcacaagatcagcaccgagggggaaatccgcccccatgatccagtcacctctcaccaggccctatcgccaaaattagtgattacaatttgacatgaggtttgggtggggacacagatccaaaccatatcaactagttagttatatacatgggaactaagtgatgtgctataaatgccaaagcatcaaactggcactcagaagacctgagttttagatcttactctgtactcagtgaccttatacaagtcagtccacctttctctgaccattgtgagatggggttataatttctgccctgtcttctttacaggtttgttatgaacagttttgttattttacctataaaatgaaatactggagatcaaaggggtttttaaatgttcaaaaactggagggattagctaatgattttctgttgcttcctggttctgggatgttctgaccagaaacaatctaaagaagccaagtctcttcatctcagagcttggaaatagccctgagataaagttagacaagaaggttaatattcttaaatttaaagctcagaggatcccaaatcaatttccataagaagttgagggtcacttcatctcagaggtgttttttcccatgagtctttgtgtcagatagctctgtgtcatgacttttccttaagcagccaggatccagacaaggtaagaggcagaagggtctgtggatttccttgtttgtttaggaactctaaaaaatattgtttttgttaattgggcaaagaacaaaggcctcctccaaatgtaggctttttggaaaatttgagactgctaattttctctaaaaattgcagcgactatttgcaattctcaaatctcattgtatatgagtgacaattttgcttgccctgactgaaaggtgaggcaagatggggacaggtgggtaagagagacaggttaattgtggggagaggtgttgatatttccttaaagatgactctcatagcaatgtatctttcagatgttttgttacccagcagtgagcatcaatcccatgcatttactcgttcatgcatgaattcatttaacaaaccctgagcacacgtgccagttactgtgctaagcaatggacatggggaaatgtaaaagatagggtcttagccctctaaaattcagtctagtgaaggagacagacgcgtaacataaaagctttcagtggaggtatgagaggagagctatgagggcacaggggaaagggcaaaaagctgtatcaggaattggagaaggcttattgaggaaagtgacttttgtgctgaatgttgaaggatgtgcaagagtgtgtgatgaagaagaggggctgagatggcaaggcacagtttaggtgaaggaaacagcaatgggcaaagaaccaggtggtttggatggccattcatttgagagctttccattaggtatgacaaccttggaaaattaatctctgaaaaatacccagatcaagtttgaataattattttgtgtgcatttggaatgagcatcatctaccttccgcaatttggcacataaaaagaaaatgattgatttagggaaggtttaagaacctactgaagcactttgttttttcttttttctttttttttctgagctgagccttttcctcccaccccaattctgttgaaagcaataaagctaaatggtagatcaatggctttgccagtaaaatacccaagttccactggggactttaactggatgaaatttcagttcaatcctgggtcagtagttttagaaaatatataggtttgggacttggttcaaagtgattcactaaatgttttgttaataaaaaataaaaggagaaaaatattctaagcaaaaaaaatgcctatctgggtttgattctgggctcaagaaatgagtgcaagtcattccaggtttttgccataatttagttcaagtcctggtgtccaactttgtgatgaaacacccccatttaattttctgttcaaattgttctattctgctgtaaaggctatacaatagccatctttttaaaaaggcagtatctaaatctagtgatagctgcaatggacttctggttaaatagcttagtttaggataggcacatccaacaagttgttcctacctgagaaaatctttgataagaaagaataaagaactaagtagaaggatattcctttcaattaaaaagacacatgcttaaaagatagggctagtaaactgtttaagaattatagctatatgcatctgtcttctcgcacctgtgtacagatagtgagagtctgggaaggctgaactgagcggaagtcaatgggagagtaactttagtagcaggaattagtgctgctgtggccaacagaaattccaggttctaggccctatatttattattgtatttaatacttggatcagccagaggttagataatctcttagtcacgttttacagatgagtcagctgaggtttggctaagttaggtaacttgcctatacagatccagggtagagttacaaagcccgtattctgtgtggatccagagctgtgcccttaaccactgcgtctcaggtaagagctgtaggactgagtaatatgacacatttcatgtctaactcacctaaattagagaacctaagctttaaagggttctagagcaaaatgaagataagcaaggtgagttggaaagtatagaaatttacatcattgtctgtatataagatagatatataaggtgtataagatagatgtatagatataaaataaatatctaagataagagatataagatagatatgtagatatgatagatatataaatgtataagatatgtaagatagaataaaccgtgcaagtaagtaagatgaatgaggagattcagattcccagcttcccacaggacttctcccctgacatgttttcataagcagctaaaactctatgtcccggactgacctcattagtaccccttcctccttgtcaccccttcacctaaaacctgttcttcctgctgtggtcttggaggcctcttcccctctctaaagtcatctctcatccctctcccaccccactttagaactgtgtgaaagttacttttgaattcctggtgcctagtcccatgccaggcccacagaaggcatgggtgcttgctgagtgaaggatgaataaatatttcagtgctgagtagcgtgcaccccccaaatggacttcccctactgatgatgcacacaggcaaatttaaacctttcaactatttgtgtcacccacagatgaacaaatgcaaaaaaaaaaaaaaaaaagaaaataatcatgagagaaaagagaaatacagcattaaatattttaaaaagaataataggttatctcagagtatttaaggattctattttcctttaaaactgtgcttttaaagcataaactatattcctggtcatttagtatttgcttatatttggctgttttaataaaggcatattttaagacacaatgcggaaattcatggttataaatctgaggaggaggcagacagaggagtcactatttgaatcttaatggcctcttgactagaagggccctgcacctgaagtgctctactcccacctggtggtgcaagcagaaaactgccaacatacattttaataattttttttgtgtgtgtggagacccagtctcactttgttgctcaggatggagtgcagtggcgtgatcttggcttactgcaacctctgcctcccaggttcaagtgattctactgcctcaccctcccaagtagctgggattacaggcgcccaccaccacgcccagctaatttttgtatttttagtagagatggtgtttcatcacattggccaggctggtctcgaactcctgacctcaggtgatccacctacctcggccttccaaattgctgggattacaggcatgagccactgcgcctggccaagaattttttttaaaaataaataaacacacatattattcaaaatgaaagtgaggaagtgactgcaattgtcacagaatgccattcatcctaaagaatttttattctttgtcattgccttacagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcagtaagtgtaacctgcagtagaccctggaaaggcctggtgtctgtggttggatgacagcaggagtgtgtggttggctgcttgaccttacagttcaatcttcttgttttctcagtggtggcgggtggaggggggcggctggtaatgtaaaaagaatgcctgtctcccaacacgatgattgtgttctggtctactccccaaattctaaaagccagctcagagatggtgaatatgtagggaacaggcatggtcccaggtgagttagcactggaacagtcctgaggggcctagttgaatcctgaacatctcaagaaagagaggccaatatgggggagtgggtggacattgagtgatctgttacactgatgttatctgtatgcacagaagagatctcaaaagtctattccctggtttcaacagacccaaccaccgggattttggtcattggaaatctgacaaattttgaacaaggttattaccagtgtactgccatcaacagacttggcaatagttcctgcgaaatcgatctcacttcttcacgtgagttgaccatacaactttaacggtttctccttaaatcaagtagtctgggcctgtcagacaaataaattagttaggatccccagttagtgcttcctgcttctctggagatttgtgtgctttatatacaggctgatatgatgaatgaccatcctaatatctaatgctcacataataatatatgccatatgctgccctaaatcctttacaaaaagcaatttgtttgcttcacaaaatcgctagaaggtaggtattactattcaatactaaaaaagaagcctttctgataacagcaggctgaatttctctttgtgatgctgttggtaaatccaggtgacactgtagctctgacaaacatataccttgcaaagatctgccactaataataatagtattataataataacactcgtacccacaatcacggtagctactatttgtggagcatgaattatgctgagtattatctcactctttcctcccaaccacccctatctagggaggcagactattgtcggcctcattttgctgaaaagaacactgaagctcagggaagtaaatgacttgcccaaggtcatccagttagtaactggcagagccaggatgcctctaaacctcaattttcctattcgaaggtgcttactcactctctgagtgtaagatttaagactcctggaattgtccaattgagctgacccaggggcaactcctcacaaggaatatctcaccaaacatctcaaggatcacttaataacacttaggatcttttttcaaacttactttgaatttgtgattttaatatatgccatatccagggatggcaagttccagtgggtttttgctcttcctatgcacctgaactttcttccttttatttctcctgaagtttgctcctttattctcatatcactttcagctatatttcctgcatcatttctgttatctttctttagaattccctcaatatctttttgccttctcagaggtacaatcatactgcagatgtagagatatgtaggatttggacttgagcattgcttcctttctagtcttttttccaatgatgtccagcactgccttcctctctccctcccacatcccttctttcttccttccttcctcaaatatttattgaatatctactgtgttccagggactgtcctaggtgataaagatacagagataaagaagatgtatgtcctatactcaaggagctcacagttcagctagagggacaaacacaactaaaacatgctaaatcctataatagaagtctgaacagggtctatagagcaccaagggaggaaaattatgcttatagaactgggatggctttaccaacaaagtgctatttgagcaggatcttgaaggaacttgcaaagcctcatcatctataaaatgggaaagctgaagcatgacggtagagcagcaggcttaggagagcaaccaggtcatgatgggggaagagaatggagggcttcacatggcatgtctctgagggaaaaatcacaagaaactgatatatcatctgatatgtttgaatcaattgaaagaagtttaatggttttgttggaaatttcgggatgagtgataatgcatttattaatccccaaatgaagcaattattaacctccgggaaaatttttgtaaatgttgtacaagaaagaatcatagtatactgtgttcctcagctgtgaacaatatttatatagccatactactgcaaacttggatttaactaaaacttgtgatataactattttggaagaacatggtgggtgtgaggggagtggtgtaaaagagctcaatctccaacttctagggtacgaagttgaaagaaaatgatggaatggaaaaaaggtaggacatatcagagcaaacataataaaaacatgggggcaagaagacttttaaaaagagttaagagtggttgcctttcgtgaatgggactcagaaacgggaaggagtcgggcagggaactgctgtttttgtgagacatgtagtagaactatttgactttttaaactatttacttatattctcttaatcataaaaagttaaaggaattattatcaggcagctcaaaatataaggtgtccatccttgtgtgaggggaggcagatggggttgggttggcttataacccagatgtggtcttccagagacaacacctcagggcttgaaggtctggtgctcagctggataatgtcccactcattaagtttgtccatagaccgagacaataaaccagatgcctgtttatcaaaatgggcatatcacttcccagtgaccagagtgcatgaggttccttcgtaagcattgacgccatgggggaggtttttagggaccaatttcacctgtgctctgggaaagcctagtgaaatgttcctgcctgtaacagaggcttatctctagtgaccagatcacaactccatggtgtctcaagactcttttctctaaatcccatttcaaaagcaaccccacctcctccaagttggccacattttattctttatgtgcacaaatgtcaatagtcttctcccactgtgagtccaaatgacagagttctaggggtttccatttccctagcctatacaagtcattttcccactatgtgaatggccctgatattccccactagtcacaaacacacattataaaatgacaatatattccactttattaaccagctgcttgtatccttcagatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagtaagccttcattttgttgtctttacttgaatacaaacatttctcaggcatgtctttttcagtcatcaattcctaagcactccttttagtataagatatcagaggtatctttctgtttactctcattgaatttaaaaaagaatgatgatggctgctatttattgagtgctgtgtgccaggctctgttctaagcactttatgtacatcaactcatttagctatcacaacagttttaggtccaagaaaacattttcatatataatactaacatacttgtcttaataccaacatagtcatgaaatataattttaaatttttttatggaacaagagacccacaaggacagtgcccagggaacacagaagttagaatgtggcccagcccacagctcatgctcttaatcactctatttctttcctagtgtgtatctcactcattcattttttttcatctccttgcttctacaactatctattgggtatcaaccaggtgccaagtattgtactagatggagtgagaaatagcgatacatcagagctatgaatttggaccttaaagaccttattagattcttagactctttcattctgacattattttcccaccttgaaacactgctctttcttaaactttcatgatattgttgagacctaacctttctgaatccaaaatgacctatggcctgacaatgagtcagaatatcagaaataacagatttcctgaagtctgggacctatggtcattgaagctacagaacatatggtttcacatgaaatttcaaagttagcatctccctaacttgttcttttctgggccttctttcttgcaggccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctcattttagtgactcctaaggctagtccttttataaacaactttttctgacatagcatttatgtataataaaccagacatttaaagtgta

SEQ ID NO: 3604 - DNA, 34083 bp, human
gcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtaaggaaaggatctccaaaccaccaaatataattggaaacagagtttccttttaaataaaaattccacatttttacatagaattttcatctcctgtacttcaaatgaattgtgattagtatgatgagttaattttcagaactcttgcttagcaaacatatgccatgctgatatattaggggtgtaagcccataatattattgttttatggagcttctgaatgaaaattttctcagaaaaaaatatagtttattactttacttactttgaaaagtgaaaaaaatgaatttactcagaaaccaaactttgtgctagggataattttgtctctgttttacttactttagtgtttcctttaagctcagtgattgacttgctctagcaggcagagcctgggttggagggcctgccctggcttacatatgggaagaacagaaatttactgagtactttactgtctaatatttcttaaggagttgtggttttccaatcctaagactgtattttgcaaaatatgtgagtgatttatggtgcacaacatgggtgattttaggtatctgaacagaagaaaatcaattttggaatcaaaatactgatgttagttagatccaggagagatcattaattccaaaaatcccttgggtagttttcaaatatcagatacattttgcatctgttcttataagttaggtccatagtaaatacaataatattgtttatccaaaaacaggattttcaagccattagtaatattaggcagtggttagaatgaggtttactaggcgtattaatgacataagaaaatacccacgataaaatattaagtgaaaaagcaggatgcacacatatgcctagaataaattactagaaggttatataccgaagtgctcatggtggttgcctctgggtgatgggattatagatgattttaattttatttcccagcttttcatacttcctgggttttctacgaagaacattatgctatttttataattagaaaaaagtgttacttttcaaagtgatctcatgtttagaaatagttctttaaatgttcattactaaatgtttaagcatagatgttttatggagttaaacatcaccagaaggcaatactccatttgtccagtgacctaactaggccctagagctggaaacacatgttcctattttcccttctccccaggcatattcatttaaatgtaactttagatatggaagttttgtctcttcttaaagggtttccagtcattagccagttgggtcgacccctgggccttctgcatcagccctctaagatcatacctgtttccctatgtgaagccttgccctggcccatactaggcacagggtttggaacggttgttaagaacagttttttttttttttaactgtacctaacatacaagtaatttttactgattataaatgtaatgcatggtcattgtagaaaggttggaaatatggaaatttaaaataaaataaaaatcatctgcaattttaccactcagatttgggtgaattattattcttttatttgcaggtgtatatattacattttaaaaattgggtttattccttgtatacttttttattgtttaaaaaaattgtttagcatcatgtcaggattttattttattgtgacttttagaacaagaccaataaatacttcagagtgtgtttcctaagttactatataactgattttgttggtatatagtgtacactatatatctacacacatattatctagttggcccaaagcagtagtgtcagtacagcaaattgtggtatgctctattgtcgtttgctgtgcttacatatgtattgaagtcagagaaaggatcactttagtaatctacacctgtcattagcagtgttcatcagttgatctggacaactgatagtgtttccatcaatgtgcaatttgatgttcttcctggacttgttttggagagaatgtcactttttggtgttaagcgtggtgcctaacacatagtggatgcatagtaaatgtttgttgaaagaatgaattactttcccaaattccaaacatccagacatcattttcacatacatatttaaaattgattttgatataactaaacaggtcagattttgcttaaatcaaaatattttcaatgacttcttaggaattcttaggttaaattctaattcaggaaaacgagttttaatcaaacttctgcaaaaaatttatgcatatcattttaggtatttgaaatatgtattagtcacctcttagaaagatatgttaatgtgggtttcattttctggaggtatatgctatgcattttaaaggagtaatatatttgaactttgagtttgcactcaaatccaaaaaagtgagtgatcatttgattatattatttcctaagtcaaaatgaatctattatatatgaagttgctggaaattaaatcacttcaaatctatcagattaaatatgaatatttgggggatattttgctgtggtacattaggaggataataatccttctataagcaaaatgtttgccaccttgtaggcattaaatgaatgaacaatcaccaccaaaatacaagacattctctctctctctctctctctctctctatatatatatatatatacatatatatatacatatatatacacatatatatatacatatatatatacacatatatatatacacatatatatatatacacacatatatatatatacacatatatatatacacatatatatatatacacatatatatatatatatacacacacatatatatatatatatatatatatatatatatatatatatacacatatatatattcttttgagacgaagttaagtcttgttgcccaggctggagtgcaatggcacgatctcggcccaccgcaacttccgccttccgggttcaagtgattctactgcctcagcctcctgagtagctgggattacaggcatgcaccaccacgcccggctaattttgtatttttggtagagacagggtttctccatgttggtcaggctggtcttgaactcccaacctcaggcgacccgcccacctcagcctcccaaagtgttgggattacaggcgtgagccactgcgcccagcctaaaaatatttttaaatgttgattaagtgtgtacatcttggattatttttctttaataataagcacttttttaattattattatactttaagttttaggatacatgtgcacaacgtgcaggtaagcactggtttttaaaagagattacacatatttcaaccacatatgcatttttgttttgtttttaaatttggtcaagtcagagagggacattgcgttcttgggttttgtttaaatcagatactaatctttactttgctatttattcacagtcctattgatgtagagatttttctgacttattcaatttttaaataatttctcaacttagaatgacttaatccaaaggaagggaacttttttccctgacactcagagaatcacctccactttaggactaagtttgcactgcccattgtctacatgtggctattgaaatttaaatcacttcagattaatgaaaattataaagtcagttcctcagtttcactagccacatttcaagtgtttgataattctatttgggctactgaactggatggcgcagagatagaacatttccatcatcacaggaagttctgttggacagcactgtaagggtgagctcagaggttttaagtaatgtgcactaattgaatgatgtgacattttaaaaaggctcatctggaaatatataacttttagctctgaagcatatcatcactatatcatggttggacaatgtctgaaaaacatcttttcttcagaatttaattggttatggtgctaagaattgggaatctgggcaataaaatggcctggaggttttgctttgccaactgttacttatttacatgacaatgtgtagtacctcaaaaaatattgtctcactttaaaatttgaaattaccatcctaattccaaggtgatattattaaacttttgcagatttctaattagttacacatttatatatcttctatatttaaaatgttagaaatgtttgaatcagatttatattttccaaatccttgattttcattcacctctattctcatctgtgctataaatggcttcctgctgcactgagggatggcagagattgtgtctgtcatgttcattcttgtttccccagtgttcagcactgtttgtggcacaaaatgggtgctcaattgatatttgttgctaggctccacagcctcttccatggcttgacttgtgtgagtactgtgtgtactctgccatcaaacactttttccaagagtggtcttcaaagggggtttgtggggttttgtttattgttttgccttatctgttcataaattctcacccttaaccaatctcgtaacagatactgggtcccaaactagagaacaaaaattatggccaaataatatctctaaaatctctgtttttagggaataagtctgggaactttaagggctaccaaaaccccagttttatcctttttattttggacactttaaagacatttggaagtcatcatttaagcacggccagagatgtggctaacttccaggagaaatgaaatgggctctttgagggtgggagggaaccatctttctccagtgaagtttttgttggaaagattagctgctttctgaaagccaatttcctttttggaggaggcattatggaaaccaggaaagcatggggaggagaatattgggaagagggaaactgtatggagttaaaaagtgctgcatttttgtttgcattcaggcacttttcttaatttatcagtgcattggttgccatgtaaacagccagcttctggcaggaaagcagctggaccaggtgacctggctgtgacagagaacacagatattgaatccatgaaaccaagagtaatcagtacaacgattttttttcttttactttttaaaagtgtttgtcaatcctttaagttctttttgtctgactgctgtcattaagtaagaaaaatatgaaataaataagtctttgggtatgcaaaattgggaagatggacaggaattagtccctctatgcaatttcctctgaatctttcataatttctgtatcctcatcccttcaccctcaaccctccaacaccctctgttaccctgcaggcaactaggacagcatagagagcgtctcttgaacttgactttctcttccagtgcttgcctgccaatcccgtgacccatcctggagaacttttatagtcttcgacaatgcaatgcatagcaaccagttaataagataagacagtgactgtatagtgctccccaaagtgccatcacctaaaatagccctttggaaagtgctcatatagaactgagaattttagtgtagtggcaggctggatttgggtagggtgcccttcggtgggcctccaaatcctatggggagcttaattacttcatctttctgtaaggccaacagttctcaaaatttgtggtctcaggacaattttacactcttaaaaactgagggagatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtaagcttactcctccctcagagtccctctgacaacatcaggtaggcccaacaccacaggtaaggggggatcttcagaaaccccaccaacaacagtggacaaaagaagcatttgccttctccccaggcctgagatgtcccactttcacctagagatatcgaggtgggagggtagaacagacacgaggcataaagtgatggcaagcggcccagtctgggaaggctctgtctcagtgggtgtatgactgtcctctcctacccatagagacaccaacagtgcagggcgccagtagaagtgtcccaccatacctaccccaactgagaggcacctggaagcctgacctagggaaacctttctgctccttcaggcgatatgatctgggacaaatgtcagcctcagtgatatccgataaaccaaacagagcaaaacaatactgaaaattaaactgctgttagaacaacagaccacaaaagtaagccaacacctgcttgcatgtgaagcataaataatgtgactgactgcaaaaataaaaaatgtaaatatgagtttcctaacatagtagacaaaatgttcaatcaaaaatcatctgtcataccaagaatcaagtaaatcacaacttgactgagaaaaggcaactactgccaacattaagatgagttcgatgttggaattatctgacaaggatttcaaagtagccatcataaaaatgcctcaacaatcaattaacattatcttaaaacaaataaagaaaaaaaaggaaacttgcagaaaagaaaaagaagttataaaaatataagaaagaaggaaattctgtcatttgctacagcatgaatgaacctgggggacattatgctaagtgaagcaagccagacacagaaagacaaacaccacataatctcacttatatgtgagatctaaaagagttgaactcagaattagagtagaatggttaccagggactgtggcttggagggagtgggaaatggggagaagttgaccaaagggtacaaagttccagttagacaagaggaataagtttttaagacctattttgcagcatgctcaccatagttgataataatgtatgtgcatttcaaaactgctaaaagcataagattttagtctacacattgggtacagtgtacactgttcgggtaatgggggcaccaaaatctcagaaatcaccactaatgaacttatccacgtaaccaaacatcacctgttccccaaaaaagtattcaaaaaaataatagattttaaatgttcctgctatgaaaaaaacaaaacgaaacaaaagataggtaggccagatgtggtggctcatgcctgtaatcccgccactttgggaggccaaggaaggtggatcacttgagctcaggatttcgagaagagcctgggccacgtggtgaaaccctatttctaccaaaaatacacacacacacacacacacaaaattagctgggcatggtggcatgtgcctgtggtcctagctactcgggatgctgagatgggagaattgcttaagcctgggaggcagaggttgccgtgagccgagatcacactactgcactccaacctgggtgacagagtgagaccctgtctgaaaacaaaacaaaacagaacaaaaaacaaaaaaaaggataaattacgtgaggtgatggatatgttaattagctcgatgtaattattccacagtgtatgcatatattaaaatatcacattgtatcccataaatatatgcaataattatttgttaattaattaaaataaaaattaagttaaaaacaagaatttaaaaaatacatactttgcaattatctactatttttctaaagacccttacaatctataggctctttctcagttttcttttttcccccttggaattattttttgaataaaactggcttgtttgtcccctccccccaaaaaacaaatataaattatagaactgtaaaataaaataacaaaaatgaaaaactggctgatggactcaatagaagagcagagatgacagaaaatagaatccatatctggtgaaactatccttcaggaattaaggggaaataattaaattctcagttgaaggaaaacaaaaagatttgttgctagcagacatactgttaaaaaatagctaaagggatttcttcaaacagagaataaatgataaagagcaatcaggaaggatgaaaggacaacagaaagagcagaaatgtaagtacataaagtagactatcttttaactcatgagttctataaatcatatttgataattgaagcaaaattataacaccattttatactctagacaatgatatttaaaagtggggaaggtaaaggaaactaaatggaagtgaggtttatacacttcaatcaaagtggtaaaatattgatatgagtagactgttatgactcacacatgaatgttgaatacccagagaaaccactgggaaaactctacaaagatatatattttaaaacactatgaataagtcaagatggaatcataaaaaatgctcaagtaactatcagaaaagcaagaaaagggaaacagaagaataagaactaaagggaacaaacaaaaaacaaataataaaatagcaaacaagaataatatatcaataattacattaaataattatattgaatgcgaataccactacagtagtccccttttatctgtggttttactttctgaggtttcagttacccatagtacagtataataagatattttgtgagaaagagtgtgagtgtgtgaacacaatcacataatttttactccagtacattggtataattgttctatttattagtagttatcattgttaatctcttactgtgcctaatttataaattaaactttatcataggtttgtgtgtatgggggaaaaatatatatagtatacatagagttcagtactatccatggtttcaggcatccactgggggtcttggaatatatctccctggaataagggggaactactctatatgctattcacaagaaactcacattaaatttgatgacataggaagattgcaagtaaaaatatagaaaaagatgtaccacataagtattaatttttcaaaaatctggagaagcttcattaatatctgataaaatagtcttcagagcaaagaaagttaaaagagataaacagagacattacctaatgataaatggatcaatccagcaggaggatacaatgatccttaatgggtacacaccaaacaactatgtctcaaaattcatgaacaaaaactgatcaagctaaaagaagaaagagacaaatccacaattatagttgggaaattcaataccccctctcagaaattgataaatctactagacagaacatcagtaaatatagggaagatctgaaaaagacagtcaattaacaggatccagttgaatatttttacgattttatattggtttttccatagtggttttaaattatatctctttgtatagaaaactccacccaacaacagcagaacacacttttttttggcacctacagaacattcaccaagatagataatgtgcttggccgtaaaacaaacctaaacaaatttaaaataattgaaatcatacagagtatattctctgactacaatgcaatgaaactagaaatctgtagcagaaaagtatctaaacacgtggaaattaaacaacactgttctaaataatccgtggatcaaagaggaaatctcaaaaggaatttttttaaaaatgcgtagaactgaatgcaaatgaaaacacaacatattgaaatatgtaccatgtagataaagcaattctgagagagaaatttctaacactaaatgtttacattggaaataaaggaaggtcttaagtcaataacctaaatttctacatcaaggatctagaaaagaagaccaaaataaacccaaagcaagcagaaggaagggaataataaagagctgaaatcaatgaatttgaaatagaaaaactatagggaaaaattaataacacaaaaatttgcttttctgaaaaaaaaatcagtaaaactgacaaacttctagcaagactaataaaaagagttaagacccaaatcactaatatcagaaatgaaatatggaatatcactatagatcctgcagtcattaaaaatataatgagagaatattatgaacaattatacattcatatatttgacaacttagaaaaaaattggccaatttatccaaagcagcaaactactagaactcacccaatatgaaatggataatctgaatagctctataaccattaaagaaattgaattcataattttaaaagctcctacaaaataaatctccaggcctagatagcttcagcaaataattctagcaaacatttaaagaattattaagatcagttttacacattctcttccaaaaaatagaacaggaggaaacacttccaactcattttatgaggccagtattatcctgataccaaaaccagacaaaaacagtacaaaaatagaaaactacaggccaatatctctctcatgaactttgacacaaaaatccttagcaaaacactagcaaattgaatccaacaatgtatgaaaagaattatacaccatgaccaaatgggatttatttcaggtttgtaaggctggttcaacattcaaaaagcattcagtgtaatccaccatatcaacaggctaaagaaaaaaaaatatgatcatatcaactgatgcagataaagcatttgacaaaatccaatacccattcatcattaaaactcagcaagttaggaatagagggtgtatttgtttcccagagcagctgtaacaaattgccacaaatggggtggcttaaagcaagagaaattaattctctcacagttctggaggccaaatgttttaaatcaaactgttggtttcttctgaggtctctgaaggagaatctgtgccataagtctctcttagatggctgctggcaattctcggtattctttggcttatagatgcatcattccagtctctgcttctgtcttcacagagcctttccctttgtgagtctctgtgttaagcctccctctccgttttcttataaggacaacagtcattgaatttagggtctgctctaaatcagtgattatctcatctcaggatccttaattacatctgcaaaaaccctatttctaaataaggtcacattcacatatactggaggttagaaattgaacttatctttttgagggacacaatttaaccccctacagaggagaattgcctcaacttgataaaaacacctacaagtaacctacagccaacattatacttcatggtgaaagactgaacgcttttgccctatgattggaaacaatgcaaggatgtccactctcatctctcttattcaacatagtactggaagttgtagccactgcaattaggcaataaaaataaataaaaggcctacaaattggaaatgaagaaataaaactctctatccccaaaagatttgcatctagattatatagagaactctcaaaactcaatcattaaaaaactaaacaatccaattagaaaatgagcaaaggatataaacagatattttgctgaagatgtacaaatggcaaataatcccattaaaagatatttagcatcgttatctatttgagaaatgcaaattaaaaccacgatgattatattacttcatacctgccagaatggctagagtagaaaactgtgacaacaccaaatgctggtaaggatgcaggaaaacggaatccttttatttggtggtggtgaggggaatgtataaaggtacagtcattctggaaaacagcctggctggttttttaaaataaaataaaatatgcaactggcgtatgatccagcaattgcactgttgggcatttgtgccagagaaataaaaatttatgttcatgcaaatctgtacctgaatgttcactggagttttatccaatacccaaaaactagaaacagcccagatgtccttaaatggatgaatggttaaacaaactgtattacatatatatcatcgggtactacaaatcaataaaaaacaacaaactactgatacacacagcaacttgggtgaaattttagataattatgctgagtaaaaagagtcatcaattccaaaaggttaccatgattccttgtatataacatttatgaagtgacagaattttagaaatgaaagacagattagtggttgtccatggttaggacaggaatgaggtgcaggatggaggtgagtgtgattataaaaatgtcaacatgagaggtctttgtggtgatggaactgttcaatatcttgactgtggtggtaaatacacgaatctacacatgataaaatagagaattaaatgtgcatgtgcacacacacagcagtacatgtaaaactggagaaatatgaataaggtcgataggttttatcaatgtcagtatcctggttgtgatattataccaccatcttgcagaatgctaccattgctgggaactgggtaaagtgtacatgagatctgtcttatttcctagaactgcatgtgaatctacaaatatataaataaaaattttaattaaaaattatcgaggaccccaaaaagaaactgatatgttttgcctgagatttacctgattttaaaactataagtcccacattcaaggaattcccatggtactgggaaaactgagtcagttgttctctatactaccagacagttttgggtccctggacaagactttaagaacctgtgtaaggccgcccttaacacagaagaaattctcagttcagtgttattaccacaccatcatctagaatttgagtatcttcatatgataatttgttagaaactctcctcccactaccccagtgagccccaagaaaactcaactttcttgtatggtttattctaccttcttcccctcaccttggattcctcaaataggatgtctttgtaagtgttctgtgatgaaacagtgttatcagaatttgagtatgtactattgatttttttatgattatcttttcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctgtaaggacactttttcctaaactcttccccttttgtagttctgactgaaaactgttggggtagaaaaaatgtgaaatgtgaaagaatggcatgccagtgacagtagtggcaggaatctcagatacaaaaagtttgaagacagctgtatagagaagatcatcatctaagtgacttgactcttgtcctctcttcatatttagttataacccattatctcggtctgtgtaggtccacatcaagtggatcatgtattttagagaagacagaaatggttcttctcataggtgaaattaatagtaattctgaaagggctccccctccacctttatctccctattatttccagaagaaactagttcaaatgcaagtcctgattgatctgcagatctctgccaaatttaatatctaggatctggctgtcaagtgaactagctcactgtgctagactgaggcctgacagaatgagactcttcagatggatgaagaagggccatagtagtgatgaaccctgcgtagttcatcaagaacagcatgaggatagaggacaggggatggagtgggtaggcatagggtcagggggaagaggttgccagaaaaggatgggttgaaagtcaagggaggagaatgatttcacatgcaagctgcctattcccaggtttccttcatcaggccttgagggaaattccttctttagcccaaagattcaaattgtatactcaaaggtgtgtgtgtgtgtgtgtgtgtgtgtgcgcatgcatatgcacgtgcgtgtgtgtgtttgtgtgttcatgcacatgtttatgtgagcacatatgccatgcatgcctacacatatcccttgatggaaaaggtctgtagctttcatcaggttctcaaaaggctgcatgacccaaagcagagtttagagaagagacaagtcggtgtggtttggaatagttggatgcagctgaattgggccttgaaggaaaagaaaggttttgattagtagaaagatagagggagagcaagttgaggaggctgggggaggcctagggacaggggtggagaagaaagaaggcattagtttagaggagccacacgttggccagtgtcacttcagccatcactagtccttcagaagtgctgagtcctctgtttacaaatcctgagcatttgtttagcaggaaatgccgtacagggggagattccatcaatgccactctctagtccaagttaaacaattttgctcaatactggttaccttggacaagtatctgaatcactctgcacctctctttaaaatatggtagatcagcaatacccatggggaatcaactgatataatgcatgtgaaaaatataaagctctgtaagttttatcccttgtaaacactattatgattatcatcatccacagcagcaccaccaccaacagtgcttctaccagtttccatcacccaagatgtccagacccaaggccttgtatgtaggagtcaactaagaaattattgccttcttttgcaggatgctctgttagattgtagatggcaataatcacatgacctttcttcctttttgaaattcaatttccggactagtcttgtcaacacattctttatctgtaggcttgaaatccttctcattttgccaggtggggctggatttagggagaccttgccaatgtattttgaaatattttctgcttgatattcaaatcaagatgttctcaactgcctgaaggatgggcaaggccacaaatttttatttatgcctcctctgacactgggatttacaaggctacctcttggttgaactgtgtgtctagtgaggaactgggagggagctgcagagccgaaggatcctgtgaccagcaatgagctttttctataccaggaaatgcaagggaagaagatatggtgattgaattgagtgtggcctgagcccagaacatctcttagaagcacttttaaaaaaaaatctgttaacaaataaatatttattgagtagcttatttacttgccatttgcttcattcttcaaaatgtcaggtacaggtggggcaagtgatttaagatatatactcttttggaatgtccacatcaaaggagggcctctgcactgagctgctggatcaggcaaaacatgctctctgatcttaaagctgcatgatacctgtgttacgcctgtgccttagctgcatagaagacaagcttttgtgtttttattgctcccacagcttgggagcaataacaaccatccccctaaaggcaaattttatcctccttctattttcctgtctttctttagcttaccctagccagatccccattacaaccatttttagctctctacttctaaagaaccggagtccttcccctgactccccatatcctgctggcatgggcttctcactgctttaccagatgagtagttttgaagtcctagtggaaatctcatgatgaatgtcaattcttcttgctctgccacttatttattgactgcgtgatcttagacaagtcgtttgacctttcagttgttccgtttccaatctttaaaatggggctacttacctatctcataggttgaatatgaagactaaatgggatgatgcttgtgaagcactacgaagccttctacccagtaagcattcagtgaatgcgagcttttattattggcatcatcacttacaaaatggcgattttgcaaaatccctgttccctccatacccctggtgatctagagggactgactcatgggcactagggagcctagctcaagaagatacacttgaacagggacagagctcttcagggccatactagcccaagatcagcttcgagttccactgcttaccaggtcactgtggctaaagggagggcccaggccctttctctacctgcttcttatccctgaactgacagcctgctcaaccaagaggttgcagacatcctgtgttgaggtggtatttttcaaaatgggatttggcctccatttcaagactgtttcctctttgaaaacattcaaaattctgtggagcatgttgtatgttaatctagggattgctggtggaacatttatgggaggataaaaagactgctgcactattagacaattatgtgatttatgggactaagatgttgccagacatcagtggtcacactgagagattcagttcaactcctgggttgatgtggcagtatactgtatagcattcagctctcagatccacccatttctgctcaaacacagcacagctcgtgcctcagtactgagggtatggaggaaaaggcagtcagtcagtgtctaaaaatgacgcacgcaagagacgctcggggaagatgtagctggacctctgaggtaagaacacttattggtgtactactggacttcttcattgtttggagactccagggcactggcaccagctttaggaatgggatgggagggtctgactttggtaacaatcaagatcagcacaagcccctgacaaaactgggacagtcttgagtttaccttctcacatccatgtctggagttcttctgcctcttcctaaaggctcaggaccctattgctgccctgatcagggcagtggccagctctttccatagtcccatcttccctttcctgaaatcattgtgttagattagcaattgactctgaggcctggtattcctcaatacctaggggctgatgttatctcttactgactatcccctttggagaacagagactgaagtatcccacaggtcttcccaccaagaaggccaggatattcattagcatggtccttctctcagagaaacattcctctcagaaaatatgaacagctttagatagtcaatccctcagcagggaatctcagctgaaaactctaggccaggtatgggcaggctaacatggaaatttggggtggtctggtgcctttctggtcacacagatggcttcatcttccatccagtctgttaatgctaacactacagagaccccacctgtccctgaacagaccatgccttgactctgcttagcatgaatctctcagacaatacttattcttcaagaatgttcatagtgaaaaaataccctttgccagtctcataaacaacttagacaacttctttcccaggacctagtgttcttatgttctctggcttctcaggttttacaacctgaaatacacaggacagagccacacaataaagagttgtctgcccaaaatgccagtgtcacccctactgagaaatactgcaagttcttccccaccccaccatcaaatttatgtattgtgtcccattcactttctgctaaatctgataaattaatctcatggtaaggtgttagggactagcgaaagcttattttattctcttctaaagaatgcattgaatgggaccttccatgccttcttccaaaaggagcaactcaaatggcagatacccaggcaaatggagggttggtaagagagttggtttggaagcaagagagtctttcttttggtatcccattccttccacatgccatccctgcaccacaatacagtccaaataaaattctgagcttgtgaccattgccaccttatacctgcacaccccttccctatcctatggctagcccctctatcagcagtacaagaaagcaagaagctggaaaggaaagaatgggtggtttgctgtggatgtccatgtcctccaccttcccagaaggaatctgcaaaagcagctctggaagctaactccaactcagattcaaacagaaagcagactgaattctttcaacccttcttgtttatactccatgcttctagttagagagcagtgtcactaagctgaggaaaaagtcttttaggacaaatctggttcccagctgcacggccttgtgtgaataggaacttggcacagtaggaagggaaaggttgctctgcaaagaactgaggggcctacaattgcagctggcaaatattgagggcatcatgtggtgaacatactcagcatgggaagcatcatgccaataaatagcaacaattggcaggagaaaggttgggctggagcagggaatggaatggtcccaaaaggagaaggttgcccaggaatcatctttctcatcttaagaagcactgtgagtgccatcttaatatattcagtgggaatcagaaggtctgaattccaggtctgactgtaaattgtgtgaccttgggaaaatggctccctctattgaggcctcggtgtcctttttttgtattagaaaaggatgaattcgagtttactaaccgcaggcctctgggtcagatttggccagtggatgtatttcagtcggcctgcccagtattttgtttgtttgtttcaacagttcgaatgccttgtttgcgttgacttttccgttccctgcagtccccatatctgttatgagcttaccactacttaccagcccctcccagccatttcccatatttccaatatccatcgggctcctgaaggccccttaaccttagaaaccacaaaccaaactatctcacagaggtcttataattaatgtgcaattatgactccacccatcagcctctagcgtcaccctgggggcaggcagagaggaccttgggagaaagcagggcagtctaccatgaacccaagcacaaagtgcaggtgggtaaaaaattaacaagcgccccttaagggaacactgggatggatttccttaaaaaaatcacctcctccccacctccacccaaagatgtggcccattgtacatccggggctttttctggatctccattgctttgacgtctaaattgataatattctttctttgaaaagtgtacaagccacacaggatcatgggccaggctttggccactgttcagctttgatttttaaaagagttattcttttatggaaagtggaatcaagttgtagcccttcctatatgattagataagcagtttcaggaaaacacttctttctttttttctttacaaggacagtgtgactgtgtggacttccccttaacagaaagcccctccatgtatgtgtctggctgctgctgtctacccctaggtactttacttcttacagagaactgtgaagccaaagccttggctcttttaggtctccattgttagccctcactacccccatttctgtctctaataccttttagtgtcaatcgtgagagggcaaaatgtattagactacagcatgaggagctagcatgtaagaggtagtaaaggtctttttcatgggtaaggttccagggcctcattgcttatatactcatttcaccttgactcatgcccaactatgggacttttacagtgggcatggacacatggatacagtggacacttttacttcttctcatatcctaattctggcctaaaacacaccattttggcctcaagatctctgcagaaataaggtccttttcacctggatcctctgggacttgctgtgggcctcaggcgtgactgatgttgtatctcattgtgatgtcatcaagcatcagtataaaacagggctgatgttttacactgtccacagtctccttgggaggaggggaagtggccagatgttgaggctgtgaagggcactcttgatggacagcaggctgaactccaggtaagaaacaacaagacctcaaactgtcaattagaaagtaaataagccccatgctgcctagtgaaattgaaagcctgatagcgtgggtgccaactcaaatgaaagtaatcctctgatgtattgaacctccttctgtcccacttgaatacctggagttaatcctggctttctggtttggaagtcaaacaagaccattctggggcaagagtttgtgatttcagtaggtgtgaatgaatgaattataaatggctgcatttataatgcaagcaagaaaacacgttgatgttagaaaaaacgggagagaaacaaatagttttctctgtaaatgtactcttttcctgggatttttccctcaaaatccagctttctgccttagttttaaaatatattgactttctgcttaaaggagaatacatttgaattcatctagacaatatcttttggttttctaattgctttccctcttttattggcctgttaaggtaaagcccacagtacaaggaattaggaaaattggattccagatctgtctcaaccgtcaattttgccttttattttttaacctctctgggctttggtttcttctgtaaactgagggaagtgaattaaatgaactgtaaggccttccagtagattttatgaaaaattagtctcaccagactaagacaatacagtttattgaacaataacaatcacttgaataatatacatttacatgaaaccaacaaaacatgtacatagaaggtgtgtattatgaagggacctcaggaattacctaatccagtgatttcccagcttcagtcattcatgtaccatctacatgatttttgtcatatttgtgtatcaccagcactatttgttatttaatgttattttctgtattgacttgttttcttaaaatcttaaaaaatatctaccttaatctaccctatgcaacaatattcaggaagtcatagatttaatgtgctagatttttctgtttctaatacacattgaaatttgtaagttttcatttatatactacctaaaatcaacttaaatgcctatacttggtaaatacatatcatactttggaaaacattactctcttttctcattcagatgtggaaagtaaaggttggagagattaaataactttgtttcttatctaaaaccaggctgccatggaggcatgactagaggccacctcccctaactatatcacagtgaggggcagagctgtgactaactcaagccacctgacccctagaccaggaccctttccaccacatcatgctgctcccacagttgccattatgatctaagtatctatgctctttaatagaaatgggactagaatccagatcttaagtttaataagttataataataataaatgagcccttgtggcttcagatgggtcacttaatctctctgggtctgagatgccttatttgtttaaatgacagaagaattccagttctgccttctgccacatggggagaaagatggtagctatcattggctgagcacttccgaggtcctttactagatttcttagtttcatcttcacaacaccactataaagggatgggaccagatgatttctaagatgcttttccgctttgcttctaataaacaaaacaaacccaagtttgtctatccaaaagagtaggtgtgtctaaaaggagcatgaacatttgaacatttaaggaaaccagatagtctcactgggtaaggtaaattcaaattttaagaagtttataaaatggtaaaaaaaaaaaaatgatggttttggtttcccatcagacatttgtgttctacataatgagtttctctcaggtggattcattaagtgagcatcttgatctcctagcccaagcttaggtgttgaatcctgtcagctccagctgcctcctcctctgtaagataggcatactaatccctgccctgatgacatcacagagctgctctgagggccaaatgcgcagctgtgagcaaactaaagtgccccactgagttgagaaaccttggccacagggacctgttcctggtggggggaagatgctgcttctttatcaaaggtaatgtgtttagaagaagctttcaggtagcttatcctagtcctggactctctccagttctcacttctgttatttttctgtctagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttaggtatgagcacttttttctgctttttcttttcttggaaaaagttaggacactgaatgagccaggacagtgagttatgatgccaattaagtctctgtaggtaaatatactccctaatattttcattatcagggaaatagagacaagccaccagcccaaccaaaacagtaacactgagaaatcactcataaaacatgcagaacaattgtgcaaacgggctgccaaaatgacagcagtagatgacccaacctccagtgatccctatctctgagggatggaatgagaacagatgagacaatccactgtcccacaaaatgatcactagcaactcttttagaggaaacctccatttacagccagatctacctgggggagactactgtcaacttattattccttttaagctcgacacaattcccaccattaaattattcttttaaataaagacaggagagtcccttttttaaaatgctaatgttatttggaaaaaggactgaaattaatctagtgttgagaatcaacatatttacatacaaatattcattatatgatattgggcaagccgtatctgctcttaaaatgaatttggaatctcatttgttcagtatttattgagttacagtgatggaggtgttgtttttgcccttgggaagctcccaattttggccatttctagaagtccttacaatctctgtctgagaggacaatgtgggctaaacttccatctgcaggctggtattgggaagtatcgaagcaagggatgaaagggctgccaatcctcaactcttacagacagaccagttgagatgagcattttcccacttctaggtagccccaaatgaagctgatctagtcattgctgctctcaagctgtgtgcacacatcacaagaaaggaggaactacatcaaatcagtgacttaatagttgagtagcttggaaaagcagcaattggtaacaaggtgcatacccaagagaactgtttacagttgtcctggcttgccactcaggtaatgccacaaaggaaccagctgacatttactgtgaggtttgccactgcatctacccacctgggaaagagggaaaggtacctaagagctattttttaagagtgggttagcttaatcaatcatatttttatcttactgagttctgtgccaggaattggggtacaggaacagacaagagaagtattactcaagcaaattcctgggagagtttctgtttcagtttggaagactagtgtattagtctattcttgcattgctgtaaagaaatacctgagactgggtaatttataagtaaaagaggtttaattgtctcacggttctgcaggctgtacaggaagcatagcagcttcttgggaagcctcaggaaactacaatcatggcagaaagcaaaggggaggcaagatgtctcacatggctggaacaggaggaaggggaggggaagatgccacacacttttaaacaaccaggtcttatgagcactcattcactatcacaagatcagcaccgagggggaaatccgcccccatgatccagtcacctctcaccaggccctatcgccaaaattagtgattacaatttgacatgaggtttgggtggggacacagatccaaaccatatcaactagttagttatatacatgggaactaagtgatgtgctataaatgccaaagcatcaaactggcactcagaagacctgagttttagatcttactctgtactcagtgaccttatacaagtcagtccacctttctctgaccattgtgagatggggttataatttctgccctgtcttctttacaggtttgttatgaacagttttgttattttacctataaaatgaaatactggagatcaaaggggtttttaaatgttcaaaaactggagggattagctaatgattttctgttgcttcctggttctgggatgttctgaccagaaacaatctaaagaagccaagtctcttcatctcagagcttggaaatagccctgagataaagttagacaagaaggttaatattcttaaatttaaagctcagaggatcccaaatcaatttccataagaagttgagggtcacttcatctcagaggtgttttttcccatgagtctttgtgtcagatagctctgtgtcatgacttttccttaagcagccaggatccagacaaggtaagaggcagaagggtctgtggatttccttgtttgtttaggaactctaaaaaatattgtttttgttaattgggcaaagaacaaaggcctcctccaaatgtaggctttttggaaaatttgagactgctaattttctctaaaaattgcagcgactatttgcaattctcaaatctcattgtatatgagtgacaattttgcttgccctgactgaaaggtgaggcaagatggggacaggtgggtaagagagacaggttaattgtggggagaggtgttgatatttccttaaagatgactctcatagcaatgtatctttcagatgttttgttacccagcagtgagcatcaatcccatgcatttactcgttcatgcatgaattcatttaacaaaccctgagcacacgtgccagttactgtgctaagcaatggacatggggaaatgtaaaagatagggtcttagccctctaaaattcagtctagtgaaggagacagacgcgtaacataaaagctttcagtggaggtatgagaggagagctatgagggcacaggggaaagggcaaaaagctgtatcaggaattggagaaggcttattgaggaaagtgacttttgtgctgaatgttgaaggatgtgcaagagtgtgtgatgaagaagaggggctgagatggcaaggcacagtttaggtgaaggaaacagcaatgggcaaagaaccaggtggtttggatggccattcatttgagagctttccattaggtatgacaaccttggaaaattaatctctgaaaaatacccagatcaagtttgaataattattttgtgtgcatttggaatgagcatcatctaccttccgcaatttggcacataaaaagaaaatgattgatttagggaaggtttaagaacctactgaagcactttgttttttcttttttctttttttttctgagctgagccttttcctcccaccccaattctgttgaaagcaataaagctaaatggtagatcaatggctttgccagtaaaatacccaagttccactggggactttaactggatgaaatttcagttcaatcctgggtcagtagttttagaaaatatataggtttgggacttggttcaaagtgattcactaaatgttttgttaataaaaaataaaaggagaaaaatattctaagcaaaaaaaatgcctatctgggtttgattctgggctcaagaaatgagtgcaagtcattccaggtttttgccataatttagttcaagtcctggtgtccaactttgtgatgaaacacccccatttaattttctgttcaaattgttctattctgctgtaaaggctatacaatagccatctttttaaaaaggcagtatctaaatctagtgatagctgcaatggacttctggttaaatagcttagtttaggataggcacatccaacaagttgttcctacctgagaaaatctttgataagaaagaataaagaactaagtagaaggatattcctttcaattaaaaagacacatgcttaaaagatagggctagtaaactgtttaagaattatagctatatgcatctgtcttctcgcacctgtgtacagatagtgagagtctgggaaggctgaactgagcggaagtcaatgggagagtaactttagtagcaggaattagtgctgctgtggccaacagaaattccaggttctaggccctatatttattattgtatttaatacttggatcagccagaggttagataatctcttagtcacgttttacagatgagtcagctgaggtttggctaagttaggtaacttgcctatacagatccagggtagagttacaaagcccgtattctgtgtggatccagagctgtgcccttaaccactgcgtctcaggtaagagctgtaggactgagtaatatgacacatttcatgtctaactcacctaaattagagaacctaagctttaaagggttctagagcaaaatgaagataagcaaggtgagttggaaagtatagaaatttacatcattgtctgtatataagatagatatataaggtgtataagatagatgtatagatataaaataaatatctaagataagagatataagatagatatgtagatatgatagatatataaatgtataagatatgtaagatagaataaaccgtgcaagtaagtaagatgaatgaggagattcagattcccagcttcccacaggacttctcccctgacatgttttcataagcagctaaaactctatgtcccggactgacctcattagtaccccttcctccttgtcaccccttcacctaaaacctgttcttcctgctgtggtcttggaggcctcttcccctctctaaagtcatctctcatccctctcccaccccactttagaactgtgtgaaagttacttttgaattcctggtgcctagtcccatgccaggcccacagaaggcatgggtgcttgctgagtgaaggatgaataaatatttcagtgctgagtagcgtgcaccccccaaatggacttcccctactgatgatgcacacaggcaaatttaaacctttcaactatttgtgtcacccacagatgaacaaatgcaaaaaaaaaaaaaaaaaagaaaataatcatgagagaaaagagaaatacagcattaaatattttaaaaagaataataggttatctcagagtatttaaggattctattttcctttaaaactgtgcttttaaagcataaactatattcctggtcatttagtatttgcttatatttggctgttttaataaaggcatattttaagacacaatgcggaaattcatggttataaatctgaggaggaggcagacagaggagtcactatttgaatcttaatggcctcttgactagaagggccctgcacctgaagtgctctactcccacctggtggtgcaagcagaaaactgccaacatacattttaataattttttttgtgtgtgtggagacccagtctcactttgttgctcaggatggagtgcagtggcgtgatcttggcttactgcaacctctgcctcccaggttcaagtgattctactgcctcaccctcccaagtagctgggattacaggcgcccaccaccacgcccagctaatttttgtatttttagtagagatggtgtttcatcacattggccaggctggtctcgaactcctgacctcaggtgatccacctacctcggccttccaaattgctgggattacaggcatgagccactgcgcctggccaagaattttttttaaaaataaataaacacacatattattcaaaatgaaagtgaggaagtgactgcaattgtcacagaatgccattcatcctaaagaatttttattctttgtcattgccttacagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcagtaagtgtaacctgcagtagaccctggaaaggcctggtgtctgtggttggatgacagcaggagtgtgtggttggctgcttgaccttacagttcaatcttcttgttttctcagtggtggcgggtggaggggggcggctggtaatgtaaaaagaatgcctgtctcccaacacgatgattgtgttctggtctactccccaaattctaaaagccagctcagagatggtgaatatgtagggaacaggcatggtcccaggtgagttagcactggaacagtcctgaggggcctagttgaatcctgaacatctcaagaaagagaggccaatatgggggagtgggtggacattgagtgatctgttacactgatgttatctgtatgcacagaagagatctcaaaagtctattccctggtttcaacagacccaaccaccgggattttggtcattggaaatctgacaaattttgaacaaggttattaccagtgtactgccatcaacagacttggcaatagttcctgcgaaatcgatctcacttcttcacgtgagttgaccatacaactttaacggtttctccttaaatcaagtagtctgggcctgtcagacaaataaattagttaggatccccagttagtgcttcctgcttctctggagatttgtgtgctttatatacaggctgatatgatgaatgaccatcctaatatctaatgctcacataataatatatgccatatgctgccctaaatcctttacaaaaagcaatttgtttgcttcacaaaatcgctagaaggtaggtattactattcaatactaaaaaagaagcctttctgataacagcaggctgaatttctctttgtgatgctgttggtaaatccaggtgacactgtagctctgacaaacatataccttgcaaagatctgccactaataataatagtattataataataacactcgtacccacaatcacggtagctactatttgtggagcatgaattatgctgagtattatctcactctttcctcccaaccacccctatctagggaggcagactattgtcggcctcattttgctgaaaagaacactgaagctcagggaagtaaatgacttgcccaaggtcatccagttagtaactggcagagccaggatgcctctaaacctcaattttcctattcgaaggtgcttactcactctctgagtgtaagatttaagactcctggaattgtccaattgagctgacccaggggcaactcctcacaaggaatatctcaccaaacatctcaaggatcacttaataacacttaggatcttttttcaaacttactttgaatttgtgattttaatatatgccatatccagggatggcaagttccagtgggtttttgctcttcctatgcacctgaactttcttccttttatttctcctgaagtttgctcctttattctcatatcactttcagctatatttcctgcatcatttctgttatctttctttagaattccctcaatatctttttgccttctcagaggtacaatcatactgcagatgtagagatatgtaggatttggacttgagcattgcttcctttctagtcttttttccaatgatgtccagcactgccttcctctctccctcccacatcccttctttcttccttccttcctcaaatatttattgaatatctactgtgttccagggactgtcctaggtgataaagatacagagataaagaagatgtatgtcctatactcaaggagctcacagttcagctagagggacaaacacaactaaaacatgctaaatcctataatagaagtctgaacagggtctatagagcaccaagggaggaaaattatgcttatagaactgggatggctttaccaacaaagtgctatttgagcaggatcttgaaggaacttgcaaagcctcatcatctataaaatgggaaagctgaagcatgacggtagagcagcaggcttaggagagcaaccaggtcatgatgggggaagagaatggagggcttcacatggcatgtctctgagggaaaaatcacaagaaactgatatatcatctgatatgtttgaatcaattgaaagaagtttaatggttttgttggaaatttcgggatgagtgataatgcatttattaatccccaaatgaagcaattattaacctccgggaaaatttttgtaaatgttgtacaagaaagaatcatagtatactgtgttcctcagctgtgaacaatatttatatagccatactactgcaaacttggatttaactaaaacttgtgatataactattttggaagaacatggtgggtgtgaggggagtggtgtaaaagagctcaatctccaacttctagggtacgaagttgaaagaaaatgatggaatggaaaaaaggtaggacatatcagagcaaacataataaaaacatgggggcaagaagacttttaaaaagagttaagagtggttgcctttcgtgaatgggactcagaaacgggaaggagtcgggcagggaactgctgtttttgtgagacatgtagtagaactatttgactttttaaactatttacttatattctcttaatcataaaaagttaaaggaattattatcaggcagctcaaaatataaggtgtccatccttgtgtgaggggaggcagatggggttgggttggcttataacccagatgtggtcttccagagacaacacctcagggcttgaaggtctggtgctcagctggataatgtcccactcattaagtttgtccatagaccgagacaataaaccagatgcctgtttatcaaaatgggcatatcacttcccagtgaccagagtgcatgaggttccttcgtaagcattgacgccatgggggaggtttttagggaccaatttcacctgtgctctgggaaagcctagtgaaatgttcctgcctgtaacagaggcttatctctagtgaccagatcacaactccatggtgtctcaagactcttttctctaaatcccatttcaaaagcaaccccacctcctccaagttggccacattttattctttatgtgcacaaatgtcaatagtcttctcccactgtgagtccaaatgacagagttctaggggtttccatttccctagcctatacaagtcattttcccactatgtgaatggccctgatattccccactagtcacaaacacacattataaaatgacaatatattccactttattaaccagctgcttgtatccttcagatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagtaagccttcattttgttgtctttacttgaatacaaacatttctcaggcatgtctttttcagtcatcaattcctaagcactccttttagtataagatatcagaggtatctttctgtttactctcattgaatttaaaaaagaatgatgatggctgctatttattgagtgctgtgtgccaggctctgttctaagcactttatgtacatcaactcatttagctatcacaacagttttaggtccaagaaaacattttcatatataatactaacatacttgtcttaataccaacatagtcatgaaatataattttaaatttttttatggaacaagagacccacaaggacagtgcccagggaacacagaagttagaatgtggcccagcccacagctcatgctcttaatcactctatttctttcctagtgtgtatctcactcattcattttttttcatctccttgcttctacaactatctattgggtatcaaccaggtgccaagtattgtactagatggagtgagaaatagcgatacatcagagctatgaatttggaccttaaagaccttattagattcttagactctttcattctgacattattttcccaccttgaaacactgctctttcttaaactttcatgatattgttgagacctaacctttctgaatccaaaatgacctatggcctgacaatgagtcagaatatcagaaataacagatttcctgaagtctgggacctatggtcattgaagctacagaacatatggtttcacatgaaatttcaaagttagcatctccctaacttgttcttttctgggccttctttcttgcaggccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctca

SEQ ID NO: 3605 - DNA, 282281 bp, human
gggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgc

SEQ ID NO: 3606 - DNA, 282281 bp, human; identical to SEQ ID NO: 3605

SEQ ID NO: 3607 - DNA, 282820 bp, human
ggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgt

SEQ ID NO: 3608 - DNA, 170788 bp, human
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtat

SEQ ID NO: 3609 - DNA, 225680 bp, human
tccctgggctgctggtcttctttaccttccagctgctcacagaacagagagtttctacatacaagcagaagatgtgaaaatattgggaataaataaagtatatgcttataaacaagtaagaaaataagtatatgtgcgtgaatactttatgtgtgttatatacgtataagatctgggagcattcagcaggtattggtaattattctatggtattatgttattataatacagctatatctctgtttagctgcattgaatcctataattaatgcctcctatattgagctaatgtaaaaggtattgactctcattgtagttgtgtttcagaaagatttagggcagggaattaaataaatttagtgcagtgtttcttagaattaatataaacacttaattggaaatatttaaatagagttgatggcagctgaatcgatatctcccatataaagacttgaatgttcctttgataattctgatatatagattttttttaaagtaacaaaagaactagaaaatactttctgcggactccttggagaatcttcaagaatttgatgaagaattcttcacaacatttctatcttcctagaattaaccactttagagtctttcaaggttttggatctatttcacgagggcccactcatccttaggttctgcttagctcagagtggatttacaactccagaaactgtctccccttcccaatagcctagtgtactatcaatttgaatcagtgttgtatgcatttgggcatgtgtgcaagggcactttcgggcccatctgtcttatgtgggaatagtatgcctatgtctctttatgtgtaacctaacagtaaagttgaaagtatatgatgcacagttgcttaggtcttagcgtataggtctctaaggggctgtgtgtgaagctgtggagatacttagggctgttgtgtggaaaggtgcctgaaagtgagaaagactaccggctgcccaaggtaggggggatgattgacagcagacagccccgcccctttcccctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacat

SEQ ID NO: 3610 - DNA, 282539 bp, human
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagac

SEQ ID NO: 3611 - DNA, 282823 bp, human
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtg

SEQ ID NO: 3612 - DNA, 283865 bp, human
tccctgggctgctggtcttctttaccttccagctgctcacagaacagagagtttctacatacaagcagaagatgtgaaaatattgggaataaataaagtatatgcttataaacaagtaagaaaataagtatatgtgcgtgaatactttatgtgtgttatatacgtataagatctgggagcattcagcaggtattggtaattattctatggtattatgttattataatacagctatatctctgtttagctgcattgaatcctataattaatgcctcctatattgagctaatgtaaaaggtattgactctcattgtagttgtgtttcagaaagatttagggcagggaattaaataaatttagtgcagtgtttcttagaattaatataaacacttaattggaaatatttaaatagagttgatggcagctgaatcgatatctcccatataaagacttgaatgttcctttgataattctgatatatagattttttttaaagtaacaaaagaactagaaaatactttctgcggactccttggagaatcttcaagaatttgatgaagaattcttcacaacatttctatcttcctagaattaaccactttagagtctttcaaggttttggatctatttcacgagggcccactcatccttaggttctgcttagctcagagtggatttacaactccagaaactgtctccccttcccaatagcctagtgtactatcaatttgaatcagtgttgtatgcatttgggcatgtgtgcaagggcactttcgggcccatctgtcttatgtgggaatagtatgcctatgtctctttatgtgtaacctaacagtaaagttgaaagtatatgatgcacagttgcttaggtcttagcgtataggtctctaaggggctgtgtgtgaagctgtggagatacttagggctgttgtgtggaaaggtgcctgaaagtgagaaagactaccggctgcccaaggtaggggggatgattgacagcagacagccccgcccctttcccctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtg

SEQ ID NO: 3613 - DNA, 171855 bp, human
attagaaacaaattttggtcggtgctccctgggctgctggtcttctttaccttccagctgctcacagaacagagagtttctacatacaagcagaagatgtgaaaatattgggaataaataaagtatatgcttataaacaagtaagaaaataagtatatgtgcgtgaatactttatgtgtgttatatacgtataagatctgggagcattcagcaggtattggtaattattctatggtattatgttattataatacagctatatctctgtttagctgcattgaatcctataattaatgcctcctatattgagctaatgtaaaaggtattgactctcattgtagttgtgtttcagaaagatttagggcagggaattaaataaatttagtgcagtgtttcttagaattaatataaacacttaattggaaatatttaaatagagttgatggcagctgaatcgatatctcccatataaagacttgaatgttcctttgataattctgatatatagattttttttaaagtaacaaaagaactagaaaatactttctgcggactccttggagaatcttcaagaatttgatgaagaattcttcacaacatttctatcttcctagaattaaccactttagagtctttcaaggttttggatctatttcacgagggcccactcatccttaggttctgcttagctcagagtggatttacaactccagaaactgtctccccttcccaatagcctagtgtactatcaatttgaatcagtgttgtatgcatttgggcatgtgtgcaagggcactttcgggcccatctgtcttatgtgggaatagtatgcctatgtctctttatgtgtaacctaacagtaaagttgaaagtatatgatgcacagttgcttaggtcttagcgtataggtctctaaggggctgtgtgtgaagctgtggagatacttagggctgttgtgtggaaaggtgcctgaaagtgagaaagactaccggctgcccaaggtaggggggatgattgacagcagacagccccgcccctttcccctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagttaatgagattcttgagaggaatagcacagtgtcaagtcagtgtttttgggaccaagatatcttccaaaacttcgtaacgggttgggaaaataaaagtggaagacacaagatgcacacatttctgagcctcttccccagacgacttaagatgactagcatcaatctccacggcagaagaaacataattttccctggtcttcaagaacttgaattggcacactagtttgagagtgggaggagagcacaaggagtggaacttcaaagtgccgcagatgctatggaaatgaaacttaagtacatgcttagagtcgtttgacagtaccaggtgacaacatctggattctttaactacctgaattgaactgataccactaggtgatgttcaatttctgtctgatgtgtcgtgttactcgtttctgcatcaccagaaagttaaaagataaagctgttataatagaaaaaaaaatcaaagttaacatttcataggctgtttagatgtcatctatcaaatcaactagggactgcaggtaaagaaatttctgaagacttttggtcaagaaaagtttaatgggtcccagaaagtattgaaatctccagtggaattactaggataatttcacaaagatggagtgacccaaataatcaaagatgctgcagttttccagtttcactagctacttaagctggcagaaataaaaactgttgagtttgaatacgaagttgttcaattgttgagtactatttcactgctgtattttttttaaaaattcttaatgatacccaaagccattccctatatagatgagagatgaatatatattccaaatatttatcttgtgggttttgatcattttaactgattggctctgctttttaatattttaaatatttttaaatactattatagggccatacgtaattcaacctaataaatcacccaatgtgtttatgaaaaaatggattattttatcttggcatatgatgtctttaagaaaataccagagtgaagctatttttcttgtaaagagaggaagatgccagaaaacttgaataccaacatcttgtgaccccttaactcaatatcagttcctatgtaagtaaattctggacttcgtaagcaaagatattgatctaagactctgtgtacttctccatcttattccttcaatatacaagtttagttatgtattaccttgaggctcaataactacattaattgaaaatgccaagatttgattagttaacaattcatccaggaatcttgccacttgtaaaagtgtcatgcatgggcagaataccctcaagcaaaacttttatttttagactctggctgattttattcagtgtacttttgggaaaaacactacagatcattccagatagctgaagacttcacaaacactgcatcctgtcacttaatacctttaaaaaccactttaatgcttgcaattctttcaagtattgaaatgagtctccaaaattaagcactgctttggtgtatgagttttagactctgtctcattgttttatgtcacctgctatgtcagtatgattgaccatggtaagtctaaaattgaccttgagttccacagataatactttattttttgacttatttaagtacacagccacttccttcacttgttgtttacttatgcaaaatatctttgacattgtaaagctactttttttcagttttggggaaaatgacaaatataaagacagtcacagaataagttatcagaagatgacttttctgaagggttgttttgtttttcttttacactctttgcacgggattcttatctatacgggctggttctcgtattctacactcaattccagtttatcctcatgagtttgtgtgtttttcaccctttggattgttttaaacatttaaattctctgtgccatgtttgactaatattaacgaaaatagctattaaaaatagattggcaggaactatgttgtgttttgctatgagaaagtctctttactgtgagaattaagctgccaataatattggcaagcatttaaagattgggtcatttaggggcttttgggctctttcttttcctgagtttacaaagcacatctatataaagtaaaggaaaactaaatgttaaaatccatgttaaagaatgagcttccattaaatttactttaaaggagtaatgatcttcattcaggtgaaatatttgcacaatttatctgcataaaatagaatctaggatctcagaacatccatgtctttggctgttaggcgcctaactatctaaggggctgtgctaggccacgcacagcatgcaaagatttatttaaacatagttcctaactctctaggaatttgctttctcagacaatggtggtcattatgttccttagaagataggatgcttaatgataagttattatctacatgtacttgcatcgtgttagcgaaatgtctagaaagatacaaatctcaccatcagccaatatatctaggaaaaaacatatatcccgaagtagtcagatccttatgttttcttcacactttgccccctccaaatgagctttcaggaaaaggtctaatacaatcaagcatacttaaagtcaaaagcctagggggatacttatttgggttgggaggagggtaaggagagaaaacatttctattgttccttctgcagagagcataggtaaaatgcctttagctgcactcaaatcaaggtctgattgaaatatcaacttctttctttaaagttgtaacatgcccaggttggtcctttctgctgtgattttcagtcgtatagtagtcatcaatatatgaatattatgttaagggagttcagcgatggagacgatctcttccagttctaaagaccaagaggaatatttgcattatctggggctgtgtctctataaatccttaaagtactcttctactttacctgctagcaaatatcctatatcagctagctatgaaaaatcacaacatataatatacgtgtgtgtatgtgtgtatataaatatataatatatatatatatatatcttgggatgactaaggatactgatagaaatgtatgagtacactattaagtaaatcatcaaatgactgtaaatagataatccatagatgataatatatttacattatttataggtgaaattcaaatatattttaagatagaggaggggataatagatgttattatctaaagtgttactaaagaagcaaatatataaccatttcaaaaattgttttattatacattttaatgattgtatttcagtgtaatcagtttccattgtaatcctatgtattttattgtatacttctaaaactagcagggtgctgtggtgtgtgcctgtagtcccagctacttaggaggaggctgaggcaggaggattgcttgagaacagaagtttgaggctgtgacgcaccatcatcgtgcctgtgaatagccactgtactccaccctgggcagcagagtgaaaccctgtctcaaaaggaaaaaaaaaatagtattctaaaaaggagtccataggcttcactagactgccaaactatggcatgaaaaaagtacccctagtttaagaaaattggttttacaaaaacagtcattttctaatgtttgttcaggcatgaggggaattgtgttgactctaagtgccaacaatcttttaatttttaagcatagtttggagtcttcaataaatatgctcctatattctgtaagctcataatcaagccatatgactggagtaaagtatactgtttcccttattatctcattaatagaaaaaactgattgacctcaattattaatattggtttttatttgcctgaattatatggattatttcataattttaccacaggtgcaattatggtacaccacagcctcaagcaatccacctgcctcagcctcctgagtagctgggactataggcacacaccacagctccctgttagaataatcttaaaagtatggctgggtgcagtggctcatgcctgtaatcccagcagtttgggaggccgaggtaggtggattgcttgagctcatgagttcaagaccagcctaggcaacatagtgaaactccgtctctacaaaaaatacaaaaattagctgggcatggtggtgcacgcctatagtcctatctactgggaggctgaggtgggaggatggcttgagcccaggagttggaggttgcaggtgagctgagatcatgccactgcactacagcctgagcaatagagctagaccttgtcaaaaaaaaaaagagaaaaagaaaagaaaaagaaagaaaaaacagtatacagtaatatacttggagtatagacttgtcttatactgtgtaggtgacaagacatacacatagaaaaagaacatcgtgggataacatcaggctatattaaactatcaagtcctttatagctgcctgaatgtcccagtgaggcagatcatagggcttttacttggtttaaagtctaattaaatgtaaatagaagacctgataagcatgctcaagggaaaatagtaatgggaaaattagctaagagcaattatcaactctctttctttaatctatccctttcctagggtttctatttttcttctataaacaatattgaattctcctccgttataacaatgaatttaaacaaaatcacttcatttactttaataactctaacctcttcaattgcattacccccaagttcctgggtattgtctagtcttcatcaccaaccacttacccttcaacctattatagtctcaactgagtctactccaggcaaacagccctctttcaagctactaatggctgcctaattaccaaacccaatggcttatttgcagtccccattctatctgacttcactgtgttatctgacatttcccagttactctgatacttctttatccccttgtttttttttaattttgttttgttttgtttttttgtttttttgtttgagacagagtctcactatgtcacccaggctggagtgcagtggcacagtcttggctcactgcaacctccacctcccaggttcaagtgattctcctgcctcagcctcccgagtagctgggactacaggtgcccgccatcacacccggctaatttttgtattttgagtagagacggggtttcaccatgttagccagtctggtcttgaactcctgacctcaggtgatccacccgcctcggcctcccaaagtgctgggattacaggcgtgagccaccgcacccggcctcctcttgttttttaagacattatacctcactagggagctggtaataatcctgaaataaataatcctgaatcccataattctaaatgttgaaatcctgaaagatcaaaatcccaaaaatattctggaaaaagtaattttaaaaattatttaaaagatatttacttacatttttaaaaggatagttgtttgagaaacataaaacacaacagaacattccaaaggtcactttacataataaaatagacaataataacatacatagttttgtaaggataaacacttagtatatactagtgacagtcacacttgtatgacagttataagtagttgaactgtattcacaaagaaataggtcaaaaggaaaatgtataaagacatatcactatggttggtaattgtgtgcatccagctttataactgtagtcatctgaaataccttgatgaacaacaaaagtcttttgacaagatagataaaaaaccaccataggtgaccaccgtatatgcagtcatccaaagagccaagatcttgagaaattttatctttcacaaatgcgggtgtacaaaaagacatctcttcattcactgaggaggttttcacatttttacatacacacacaatgcttacacagaaagtcaacattgtgataatacacgttcatggaatcaaatttctgatgtccaacgcaacagaagaaaagtctgccccagctctcagagagagaccaatttgcattctctgtttgttctctcccagcctctagcctatgggatggtgccagcccacattgagggcagatcttccctagcttatccactgggactcatacatgaatctcctttggaaacaccctcacagacacacctaaaataatacattaccgggtttctaggtattccttaatccagtccaattgaacctaaaattaagtccgcaagtccaccccttgtcaacttggcacccgttatgcatcttcttaaaccatacttaatttctaaataaagacaataacaaggaaatagttccacttcacatgatgcaactaacatggcacaaccatcccatctgcgaccaaaaacacacttccccagaattcagttttcaggatttcaacattcgggattttaatctttcagtattgtgattttcaggattttagatgttaaagattttagactctagggatttagactttagggattttgatctttgggatttcaacatttgggattatagcattcaggattgtgtcttttgggattatgacacaaacttgcctcactagttctccttatacttctctgatctttttatttatgctattaattcaacaaatatttattgagcaacagctatattccagatagtatgccaggccctagtgacacagtggtgaacaagttagccatgaactttgctcttatggaatttataatctttatcagtctcttgtcctaaaatggtggattttttccaaaacttaattctttactgtcttcttgcctcaatggttttaactatgcctcctatatagtgatgattatcaaatttatatccccagccaagacatctcttttgagctctaaatctatgtttccatttgcctactaaccccttgtacctgtctctcaattagttgatatatacaaaacacttaaaacagtgcctggagtttagtataggcactcagccaaagccagctattattatttttattgccccaaatacagtatagttaaaggtgaaattgttttcttctccttcccatgacactccaaccagctgtgatcttttttatttttgttaaatgtcatcaccatccaccaagtttcagcaagaagctacagaagcagccatcagctttcattatttccaaaattctcaccaaattttgataattttaccaaaaatctgtagaatctggcttttccattcatattctgttggtttcaaacttcatacatcagtagcctcctgactggtttttctacctcctgactccatccttatctctacattgccactagagttattttactaacaacaaacccaattatggtatcttctgatttaatgcctttattggtttcttctttcttccaggataaaatgcatactacttggtttggcacatttaagggctttcattttctgacccaactgcttttctagcctcatgtctgtgtgtttcttcctaccagtccttctttccaaactcatggtgtatattacacttcattcagactgaacttctcaccattcccaaaccactttatattctttcacatctctttgcccctggatatgcagtccctctctctggaatatccttctgtattgtttctaccttcttttctatctaatgaactcctactcaatccttaatacccagaccaaatataattttttctatgaaacagttccagacctcttcagaatgaatttattcttccttctcctgtgcttccaaggagctttgggcctctttggtagcacatccatgtggtggtaagattcctatgcttatatgactacgttacattcttcaaccttgtacttaggatgtccaggatactgccaggctgagcataggtgatcaagagatgactttcaaatgagtaaacatctcctaatggctcgcaacaaactgccttctccctgtctatcttaaaaattactaatgttaactccaataacaattgaattgatggaaaaatatcaaccctgttcaatagtataatgtttaagagaaagcactctagaatcagacttttgtctaaatgttgcctctgccctctgacacttcctagctgtgtgacttagagtaactcgttttacctttctgagatttaattttcttttttctttttgagtgttcaatgaaatttttattgagataattgtagattcacatgcagttgtaaaaaatagtacagagagatcctatgtacgcttatccagttttcccctagttgtaatactataatataatatcacaacccagatactgacattgataacattcactgatcttatttcattttcctcgtacttatttgtatgtgtattttgttctatacaatgtcctcacaggtgtaggttgggatttccattgccacagtcaagataccaaagtcaacaaggatccctcatgctgtccttttataaccacatccatattcctcctccaacaacatatattaagtttttacaaatgtatacagttttataactgtctccacaattgtaataaaaacacttatttcccagaaagttcccttacactttttgcagtcaattccctcctcctcattctgcacgctaggcaaccactgatctgcttcctattattgtagttttgccttttctagaatttcatgtaaatgtaatcagcatagcacttttgagatttatccatgttgttataagtatcagtagttcattccttttattgctgagtaataaaaggaatggatatatcacatgttaattctctcttcatcagtccatagacttttaagttgtttacagttcttaattatcatgagcaaagctatgaatattcaagtcctcatgtgaacatgttttcatttctcttgggtaggtatccaggagtatgattgctatatggtaagcacatatttcattttggatagtttctaagtctatagcttcatattcactgatttttccttcttcagagtctaatctgatattaacaccacctgtgtgttttttttcatttcagatattatatttttcttttctagaaattccttttggattttaaattttacaaacttccattcttctcctcatcctggtcacattttcctctaccttcctgaacccatgaatctttttttttaaagttttattttaggttcgggggtcatatgtgcagatttgttacataggtaaactcgtgtcacaggagtttgttgtacagattatttcatcaccccagtactaagcctagtacccaataattatttttttctgaccctcttcctccagggtttaattttctcatcagcagaaaagggatgatgatattatactttgttcttgaggtattattgtggatgctgtatgtgaacatgccatgcaccaggtaggtgctaaattcctctcccatcttttccccccagtatcctcagagacttaaaaatcatttcccaattttggcaattgatgtttgataagatgagagaaagggagatatcagagaaggctctctcatttgtagattttatgtctagaacaaacttgtccaacttgtgccccaagggccgcatatggcccaggacggctttgaatgcggcctaacacaaattggtaaactttcttaaaacattacgagatatatttgctttttttttttagctcattagctattgttagtattactgtattttatttgtggcccaagacaatgctttttcttccaatgtggcccaggaaagccaaaagattggacatccctggggacaatggccatatttctcagttgtccccctcatctctttatcccaatttcaccaccataatagtaacatatgttttcaagtctttcaagtttacaaagcactttatcatatattattttgttagctgctcaagacaaccctgtgagggacaaatattctcatcccagagagattaactgatttatctaaggtcacaaacccaacaaatggcagagttaaagcccactctactgtgctatctctttaatttaagttttttatcatctcttatccggactccctacagcagacctaactgttccagtttcagactttcactgcctcctcattggctttcctgatatccatcctctctgaaagcaaagagcttattctaaaacacaaattgatcatgccactctaacatttgtggaagctccctacacccatggagtatctgatctggccctgcctacccatccaattccatctcctgtcttgtcctcatgtagctgatgtttaggtcacagttatacttgtgatgttggcttaacaggacgtgcatattcactccttctgcttctcctgtttttttcatcctctgtcttgccttcctcctgtctctacagatggacatattgttcttctcttaggaagttaagttagtatttttctgaagtctcctcttcttttgtctttctgtttctcactgttttttcgtcccttcaactaatatttatttagtgactactatgtgccaggcattgttgtcaaccccattgtgggaaggactatgtcaagcactaagccactgtagccagagcacagggaaggggaagaggaaagagagaggtagaactttgtgagatgtggatggaggataggaaagagacctgctctgcactcttacttgctccgtaactcctcagagcatttacctaacacctgtactaccgtatatctctctatgtggggtgtaattgacattatagttattgccggccacttattttgcgtccagttctctaacaaaccctttatacgtggaggactcactcctgcagcatatatctggtccttccacatttatcaaatgtaggcaagccatgaggcatgtgtctattctcaagccttttgggggttccgtatttaattctggatgtccatttcctgattttttctccttctatttctttatgaagtggttaaaaaattaaaagctgtaactttaaagccaaatatccccaggttcaaacacaaactccactattaactacggccttaggacaaatcattaaatatattattaactgtaaaattattactattgcagttattattttcccctcattcattgtgattgcctctctgctagaaatgggtagtgaggccacttgggtgacaatttaggaaaaaaaagttgtttaattatttgttgaatttgtttttcaagtgtcctaggggaaaaagagttagaattgttattttacttgttccagtttccccaaagccacttctacctctgctgccctacctttgtgatttcctgtagagacctgcttcccaactaaagattatgcccaaagacaccgccccaggcatctttgaagtcccagttcccctttgtctaacaacaataaggctagtttgccattatctttcagtctggtttgcttgtattgagggggagttggtgttattcagtggaaaatttcctggtcataaagctctacaacatttacctcagagagaccaagctttcccagaattgtctggcacctctggctctgaggctgaattggtcttttgggagacagatttttctcttgcggagggaattaatgttagttatatttttccttgctctgtacaactttgagtgaccatttttccgtacccaagggaagaggattggcaaagaaaatttaaaatgcctagatttctaaactctgtgagtgtagcagatcccttaaggactggaacaaaccttagatgtatgagatttatattgtcttttagatatgattaagttgcataaataccgtctagcacctagcatgcaactaaatatccagaacatgctcatagatactgatgttgaggttgctgttgataatgaagaaaaatgggacactctattagaacatttttcaaaatttacgacagtagaccccttttcccccaaactaaatctcatatgccctccccagaaatatcaatgtatttattaacaattcaaatttttaacagtaatttataaagtcagtaagaaggaagagcttgaaatgaacataaacatctgaaattgagagctacagaggtgtgtgtgtgtgtgtgtgtgtgtgtgtgtgtttgtgtgtgtgttgtgctgtcgcccaggctggagtgcagtggtgcgatctcggctcactgcaacctctgcctctcgggttcaagctcttctcctgcctcagcctcccgagtagctggtactacaggcacccgtcaccatgcccggctaattttttgtatttttagtagagacagggtttcaccttgttagccaggatggtctcgatctcctgacctcgtgatccatccccccttagcctcccaaagtgcagagattacaggcatgagccaccacgcctggcctgagagctatagaagtcttaatctccagtttatttctgtttattttatagaatgttgagaaaatcctgatgtaatagtgaacatcatggggtgagggcttttttatcttgctatctcaggatgctctgcagttaaacagaaatagcaagaaaacctatatttccaggtctgcacacataattcacgctctctttgtctctctcctctctctcctctctgtctctctgtctctctgtctctctctctctcacacacacacacacacacacacacacacacacacatacagttaactgggcagcacccattaatacaatcagtgttggtttccagtgtgttaatgtttggtatgtaacccatttgaatggtgcatactttgttttataacagtttttaaatatgttatttatttatttatttattttacttatgggttttttgagacagggtctcactctgtcacccaggctggagtgcagtggtgtgatcaccactcattgtaacctcaacctccccagctcaagcgatcctcctgcctcagcccccagagtggctgggactacaggtgtggtcccccatgcccagctaatttttgtatgttttgtagagatggggttttcactttgtaggctcgtctcaaactctgggcagaagcgatctgcccaccttggcctcctaaagttctgggattacaggcgtgagccaccccgtatggcctaaaatatgtttttttaaatgaaattaaaatctgatattgtggaactgccaaaatttcaaacagcacaatttcagttacttccacagtttcaatacactatatcatatggtaatcagtcattaaactccataagacagaataaaatgctacagaaggtgtaagaagggagaggtcaatatggattgtagttagggaaggcgtcacagaagtatgattcttgctgggtcttaaagaaatagtagaaaatgagtaattaatatctatattatatattctagattttccaggacatccttgattttatgatttcttctaaagaaaacttctagaaaaacaagtaaatacacaaatatatttgtatttatctggattgatgacttatctttgctttcaaaatgcagtcctattaaatattggagggacgggctgatcagaaagcataaattaaaacatgtaggaggaatcagagtgctgccaccccatacagaatctttgaggatattagaaaaaggcactccttcctctaggcagtcatagttctgtgccatgccacactcattggtaagcaatgagcaggctggacttctgcccccatttgccccatcaatcgggttttcttttgcagtgaaccctatgaagaatcatacactacagttctagcagggatgaacatggttgagtggagggcagtgagaagagctagagcacaggatgattattatggagtaaagggaaacgactgtggacagttggaacagggtcaggctatggagaccttaacctcaaggcagagggaagaattggctttgattggggatgtgggtgttgttacaacttcttgaacaggggaaagataaaagtggttaagagggaagaaactaaaagtaaagactgtgtttaaaggaaagcctttattataaaaagatagattgtagactcttggtaagtatatctatgttagatatataggatacagggagttatatgtacaaaaaattatcctgcattaagaacaatgagcaaaagacctttgatcatgtcaatatttcccccaaatagcaatcagtgctttgtaggtgtcagaagtcagaggtgtgtgcatttaataatcatgttattaataatgagagcttctatttggagagatgttactgtaagtgaggtgctggaaccagaatgttagatcgaggtttaaaactgttctttctttgccattcctagctgtttctacttgaggaagtcatcttaacttttttgtgttccactgttacatttgtgaaataatgggatttacttcatagagttattgagatgcttaaaagagataatgcacataacactcttagcattactcttggcactcagcaagtgttaattaaatcttatttgctattattattgttgatgttagggttattgttaagaacttgatgccaaccatttgatttctgtccattggaagcatgtttctcacatttaactggtcaattgccaaatctagttctcacagtacaccacatcacataacgttttgccttgtaaattttctatgtgtttattgccatttgtttaagcattcttccctcaaaggaaacttagaagacaagatttgaaactgacatagtgggcatcaaatttagtaagattttcagttttgttgtctgaagaattaaagaaatcgcaaactaaaggcaaaaacatcattttctcagttttatatcttagtgaagtgatgagactcttccaacagtatattctgtgtcagggagtttgcagctgcaatccttaaacttccaaattcttctgtttttctgtcctgccaaatccctctactgcaccccaacctaggactactggaagaatggaaggcacaatggtcatgttagaagagacctgtagctttccctgttttgatgtccagcacctgttttgagccctcagcctaaactttccagtccttgaaaccatgaaagtaggttgaggctcccattcaacctaacggctaggatagccaaaggtgctgagattgctccttctttgtccatggacttttagttttcagagtataagtcagcagggagaagatttttgacctaaaacattgcgttttagagtcagattggtggcagttcctttctgtatttcaaaggatctctctatacatttctatgtgtatattcctctggaagtttggttgtgccctcctgaattccttcgagagtatgtgttcatttatggatttttgtttgtcaatttgttttccttttagtgctgtctcttactgtctttgtaacattttgaaacagtttcaaaattacagaatagtttcaagtatagtacaaatttttatttcctttttctttctttttagacagagtcctgctctattgcccaggctggagtgaagtggcataatcatagctcattgcagcctggaactcctgggctcaagcgatccattcacctcagcctcccatatggctgggactacaggcatgcaccaccatgtccagctaattttttaaaaattttttgtagaaacaaggtctgcccaagctgggaactcctgggctcaagtgatcctcccatctcagccttcctaagtgctgggattacaggcatgagtcacagcaccaggcccgttttgttttttataactattggagaataagttgccaatatgatgccacattaccctcaaatactttaatgtgcattcttcaaacaaagatgttatgctatgtagccatttttctattttaaaaattagtatgaaatattttaggcaacaaaaagctataatatcatttatatgaatatgacataaagtaacataatgaacacatatatgaccatcacccagcttaagaagtaaaacactgccaatgcaaatgaaaccacttatgtaccacttccatggccccgcctccaccatcataaatttggtgtatatcgttcatttctaacctggggttcttaagttagtttcaggtaggtctatgagcaccctcaaattgtatgtagaatttgatgtgtgtctggacttttctggggaaaaggtccatagctttaatgagatttacatggataaatctctggcaaagtaccagatttcgtgcaaaaattgtctacagctagtgcatatacttttctgccactcatttattgcttagctttttgtattctagctttctatctaaccagttcattgagattaatttcttaaagttcacttcctcatcactaaatccaatggcttcttttcatccttatcctcattgaactacctgcagattcttactcttggctcacttgtccttctagattatttcccttcccttagcttctgcactctcttgatattccccagtctcctcatttagaaaatataatgcctaactcatgtggttgtgagaattagctgtaatgttcccaaagcacctgattgttgtatgcgctcaataaatttagctgttattagcaattaatcctcataccactgtgttgcatctcatcatcttccagctctgtattcaagatgttgctaatggacagagatcatggcaaaaagacagccagcaaatactgcctcaatgtcctgcactgctgttcattagcttactagcagccttataactactagtagttccggttagacagtatcagtaatctgtagagtcttcaggagaaaatcatttaggtaaagactagttagcgttaaattatatagagatataaatttaatttcatctcctaaagcttgtaacactattgttggcccggtcacttttaaggacctcagaaagtaaaaatgtagttctcccctgcttgtttattcagctttttgctcattctgctactaaatagactgacaaatgaaagcgtcaacactattatgaaggacacctgcttgtctcaagctgggctggggccagttattctggatggaccattgaagagccatatgacttttaatcactatttacttggagcagaatgagaagaagcatttataccagtcccctgaggctgccctgtcctgaattgtgcctttatcttttcatgtccactattagatgccagtaacagtgacatacttttgttcatattcataatagaatcctacagtattttaaggcacaatcctctgagaagcactaaggcccctactgaggctcaactgcctggaggaaaacagccaagctatctttgcctctgttgggtagagtgcttgaactcctaactgccatccattctttcaggatagggtaggttatgctgtcatagcaaacaactccccaaatctcagtagcttaaaataacctaagtttcttcttgtttatgctacgtgtccataatgagtcacctgggggacattacagagtcctccctctaggacctagatggaccagccaccatctggaacactgcttattatcatggcagaaggaaagagagttctggaggtctcacactgcatcaccaattaaatatgattcctggaaaggatatgacacttttttctcatacaccattggtcagctttgattggggctagttaagggacatcaagtattatcctaccatgtgccctgaaggtggagagctgaaaatgttcagtgagcagccctaatgacccccttgcacacttaatgcaccctgtagaaagacatctctggtctctctagccctgtccctttccctcaaacatcttactaagtcatgtcccttcgatttcactcattcttgttccattgctcctgcagaaaccaaggaacttgtcaatttgttaatttttgtgcatattgcagtctgtattgtttaatgcaagaccatggtctttttttgctcagtttgaattttttctacccctttggtgttctcgcagttgtatgctgtagcgatggacaaagatattagcttagaacaattttgtttcaataaaattatctatttttgacttttcctgccatcttgtgctatttagtgttatggtaatagaatagctataattctgtgaccctttgaccataacaatgagattaaatgatttgcttaagggtatgtaacaaggtagtattaaaggagcctgaactagaactcaggttttctgacttatagactgttttatatttattatgccacgtcctattatttaaaaggttgtataactgacagcagtgtaatttacttccagagacaattggtaacaaaagaatctggtctttaatcttgaatagaaggaatttcccatttaaatgcctccttttgaatattttgatgaattccatgtagtaaaatcagattcctgggattcctatgccaacaagtgtgtattcttgcctgaagcaaacaagtaactggccctgaatggatcaataatataatcctatctataagactcaaataaataagaactttcaccacccctgctgcacctcaatctaaaataaggcattgtatatattgtattattgcaggtttgtttcttactagtatttagaatgtcaggcaatgttccaggattaaaattaaaaatgaaatcaatagcctggtgacagcattatgtttatgctatgtcaacctgcctcagtttggagttactttttatatgatatgctgtggattcttctcatatatagtttactataaagctctacaataattcctcttgtcttaagcaaattttctactagtaagggcttaagagaaggcactagccaatgagattatcactaaaaatcacaaatgataaaggcagcatcttgtatacaaacaaatcttaatacgtaggcacagagttattgtcaagatatcaaccaaatgtcacacgggtggtccagggtatctgcaggtaccaccaacctttgcccaagatgcagtggaaggatacatcattgggtttttatatggattcaataatttaaatttgtagattaagaaaaagaagacttgtcaaagaatgccacacagaaattattagaataatgctctgaattgtgttaatagtttgtcctctggcatcaggtgatctttattactcttctgacactaaaatctgggaatattattttatgtagaagcacaaagctacatatctgaggacaatggccattagtgcaaagtcaaagccagttttacttatggtatatctgccatgatagagacattttccataacattttcttacagagttatttcttgtagttatgtagctatcaggttgatttttttttctcgtggaaaattttgtgcaaaatgaagcagagtaaacagtgttcctatcactgagcttcaacagttatcaacttgtggccaatctgctatgagacctttatgaagattatcataatcgtttgcatttcatgtctgtgaactgttttttaattatttttcactttccagggcaaccacaggtataagtgttaggattttacataaggaaagagaatttattcaaaccacttgaaaataatatccaaagtattcatgccattagcatagctcagccacagatatcaaccaatttcctaagatattcttagaggcagtcagacagcatccttctattaacacctattcgttatgtcaaatcacttagaagctagaaaagcaccattgcttctcaactatggtctgcaacatttgggtgtctgcaaatatgttcttggtgatctaacacttcttaagtttaagaaacattgttttaatatcaaaatggtaacactccttttgagtgttcactcttactcaggttgaattattttaccagtacttgttttttaaaatggcaatgcatcaccaaaacacatttccataatatgatttaactttcttatgtcagtgtttctcaaataggttcatgaatccattctagagttccttagagttctctgaaggatgagaaataccactctaagggaagaatgtagaatatttgataattttatgaaacaaaatacatgtatggtatagaagcctgtttcccaatctaggtaggatgctgtatcgggttttcatactatgtaagtaaaacaatattctctatatatttgtcttaattaataaacattgaaatttacaacagtttatttttctcatgcagagctgaacattaaaaattatacctatattacaaagaacaataatttggtagaaagaaggctccagactactgatacacaggttattcagtggcagtaagaggcttctaaactgacttcagaatagaaacttactaatgctttcagtttctttcagaactgtgaaagaacaagaacatagtttaggccattctatgtacattaattactgctactactaatactactactactaatatgataacagtggcaaaaggatgatgataatactatatgccagttattgtactaagaaccttatttacattttttacttcatcctcaccaccacccaaacgcagtagggtggtaggtttcttcttcatgtgtgcttgtggtgctgctgatatcaggcagagtcctttggtggaagctcctggagtccatctgcttccagttcatatgggcagtttctcctttcccatcttgcagtaggttgctactgctataacattcattcccatattgcagtatcaatacttcatcagcatctaatatttgtacacagttaacacagtctcttttacacatgtgatctcatttgatcctgtcaggaacacaatgaaataagaaaggaaaatagagtattaagtgaactttagatgaggaaatggaggctcaaatatttcttaattcatcaaggtataagtcttcttcatattaccttctactattgttatattgaatcttgactcttctctaagtgtgaaaagtacagtcatctttgtttaccagttaatagggagatagatcttaatcctcattgattgtgcccttctacacccaacaaggtatcaggcacaccataggcacttaaaaaatgcagtaacttggcttgttagattttgtacttaaatggataaagagctaaaagaatacaataaatttcaggtacgtcttgcagcaggttagtatgtggttattcattaagctgtgtaatttctatctaaatcttaggaactccctaatacagaagggccccaaatattttcctaccaatgatcacacactgtctaaaagtaaactattgtagaaacattcctttggccactgatactcctagacattatcctaaattccatacatgtctaggaagtacaagtaatttccacattagtgaaaaatagatttttaaaaacatttttgctgaggatttcactcaggctgtttttaaaaagataaaagatagttttggagcagggaacatgattggggtgagtttacaaggagtgctgtaacaaattgtttattttctactctaataattataactggtgctttttcagcatacactgcttgccagactttatgctataaataatattattattccattttgcaaatgagaaacctgagactcaaaagttaaatagtttgtggagggtcaaaggctagcaagtggcagaactgggatttaaaccaatgtctgactaagcccaaatctcctgtttttaacaataaaccttcactgctttgtcagtgggagtaagaagaagcagcgaggatgaatgggaaagaatatacaaatggttgctaggaagatacccatgccaaacatttacttaagtcacagtggagactacaagtctgtggactcaagtcctatggcagatattttggcttaaatcctcctggaggtaaccacttccctttcattcagcgtcaccagctactttatttttcctgtgcttatttggttaccctctttggtcttcagtgttgttgtttgccaggtgaagcctgaacaatatagtcagatctcctttgcataaaccttatcttcagtatgcagctcaaaatgtgttatttataaattctcatcatttaaggctactagcagcaatgaataattcatagtaagagttgctttttgcaactagtaaattgaaaggttgatcattcttccagagtgaactttaagaaactcattctcacaggctggaatgatgaatgataaggatatttcctttaaacttgtgtttagagtatttatatatattatctgaattgaactacttaccagttatatcagataggtagggattatatacccattttgtagatggaagtgactgaggcttaatgatattaagttattaacttgctaacagataaaataaccatttacaaagccacaagttgaatcagttggtcttcccataattctgcatttcctgttcttcttgcccatcctgtgacctagtacattcctcttcctctaatacaagcttcctgtgtgaaccaaataaataatataggcattacattttacagtagtcagttggggtgattgaagggagagcccatttgggaccagggtaaacaggaaagttttttcggaggaagtgaaatttgagttgccacatgaaacaatggcttactgatctccctcattctttcataaatcctgtaggtaggaaagagatatgctttcctgattccaaattaattcagctatgtgtagatatttgctaatagagaatggtgggtatggagaggatgatatttgtagaccttttaaaagtatgtttacattaaaggaattagttggagagaagagaaatcctacttttctgccaaggtaccttcaaattgcactacctccacaaattgtactatgactgctctggcctccattaatcttacatttatctgaaatcctctaataactatagtgtagactagctgttacaaactggtgatccatgatcctaatatggttcaaagacatgttttgttttcaccagtgctgctgtaggctaggggttggattattttttcttttattctttttgtttttgagacaggatctcactctgttgcccaggctggagtgcagtggcacaaccatggttcactgcagcctcaacttcccaggctcaagtgatccttccacctcagcctcctgagtggctaggtctacaggtgtgcacccccatgctcagcttcttcttctttttttttttttttttgagagagaggcagggtctcgctatgttgccagggctggtcttaaactcctggactcaagcaatcctcccaccttgacctcccaaagtgctgagattacaggcatgagccactgtgtccagccaggggtaggattttatttattttcttggagagaagagcaggattttgaacccacagacttgccataacctctcaacaaggctctccagatgttttggtatggtgaaatacaaccatattgggagatttaggtttcaacagttcatagccaaggacatgtgtggtccattgagcaaaatgaccctcttcttcctcaacacttatgtagaatacacttaggaatggtctcagcattcgcatcttcctaactggagacagaaagtacaaaatggcatcaagctttctgagagattagatcactgccctattatgtttctttctgcctcagagcattttcctctgaaattgattaaagtcttttagttaacaggcagattgaatataatcttttcctcttcaacctattagtcactgactactgagcataactcagaggtttgattagagagttccattaaaaatcatcatacactgcattttccatgtctctatgaatttcgctttgctctgtgcagtggccatagacttaaccctcaacctgcattttgtaacaaatgacatgaggagagaatgaaacctttaattagtgtctcttgaggatgttatggttctgaaaagctctgcaccgatgagaaccaccagatattatccacactgtgtctgaaaaccagtagtaatagatgtttaactcctacattgccttcagtctttgtgactctccagagtaccagggaccaaggctgggaaaccagttctaactggactgtctagaagccaggtaaggccagcacatcctgtttccatcaaagcagtggaaactgactgaatactgctaacacggtgaaaccccgtctctactaaaaatacaaagaattagccggctgtggtggcaggtgtctgtagtcccagctactcaggaggctgaggcaggagaatggcgtgaacctgggaggcagagcttgcagtgagccgagatcgcgccactgcactccagcctgggcgacagagcgagactctgtcagaaaaaataataataataaagaaaagaaaagaaaaaagaaatgcttctgatgacctgtcaggttatcttttccttttggatcctaaagaacatgctgaatcagctcacatggactggaatgacactagacgccagtgttatgattaactctgtaagccagacaatccattggctaaattctatccaacagattcttttcattcttttaaaatatgttaagattaaatctatcatcttcttacacctgaattttggcatcagtaatctcatttggagattcacacttttgtaccctaattttgtgtgggactgtgatgctaactctctagcaccaaataaagcctttttacttcatattactttaactagtgtagcaatcctgctgtgtgcctttaagaatactaaacattaagggtctataacctactcttccaaattccacagcaaggtattaccttcagctttcttcaaacaagagcaaatgagtcaaatgatatagactgtagagcaatgaccaacaagaccttttgaaagaaactcacttcctcacctttgattctttggcatgcataccccaaatcaattacatgggactccaggctgtgttgatttttttatttgtgccaaaattttgttgaattagctggaatatgaaattaaatgtgttttcacctgggtcagggaaatgcctttgttatgcagtggttgttcagctggcaggtgtgtacctgcttggttcattatacactggctgtcagaatcctacctttcccatgttaactaggctcccttttaattcagtgaagttggtgcctgaggtggttgggtaccggaaggcaacagaagagacaaagacattcagttattttgtcaaattggtgggaacatcagtagagtggagtgctagctttacagatctcctacaaacagaaaatggcccctgaaatggcatgtgatgacagcgatgcatccttacctctcacctatgcttcttccttctttatgaattcatggcagtcttggatttagtagaatgcgtctttgcacaataagtttagacttgttaagcgtgagagactatatgttcaaatttccagtgagagggatataggaactccagccagtgaactatactgatgtatctaatatttctgagagaatataaattttggtttgtcctatgttgtgccatattctctaagtaatgtaattacaaagaataggaataaaccagtatttacatataatacttgtttttggaaagctagataagcctataaatcttatgacactatcttttactccttttattgagcaggcattttggatgggtcccagaacacatttcatgcttttctattaaaacaaacacaatgttattcctgtgtgtcttttctttttctctgataaggcttatctcgtgcttctcttcagtaagatctaggtgtgcttttgtgaaaatccctattttagtctgtgaaatgcagcctccagcaaaacaggcaccccatggcctcccttgcatagtttccataaacctttctttcttcttccctctgatcccacccctatcctcaacaccgagcaacccctcccttcaaacagcaccagaggaaaaaaatatgaaactaaagagatgcacttgaaatgcctccaggttttgcaataaagcttaatgttctaagcatcaactttggcatgcacaagcacccgggatttacaagtctcagataattacagttctaagcagttgaagtatatctcactctctgtttttcctgccatataatataatatcctcaatacattaaattaataaatgacctagtaccctcatctaaccctctgttttaaggggacaaaagtaatggaaactcactggataccaactaggggggaacttctggccctgccactgtggccttagggaattcacttcaactcttcttgagttgcttcatttgtaaagtggagataacagtgtctgtcctgttcacctcacatggttctagccaatttcccacatactagtgtatatgtacacaggccccacacaccttgaaaatcatcttatttcagactccctccttccctatcacagacaagacaaaattgcatacctctttctataaactggcatctagaagaaattaaagggtaaacttactatcataatcatcaatcttatctgtcttttccttatatttttaaggtattgtccacttgccaagtgaaaagtagctcttacaaaagacatgatttctgtatgtaattatgatttactggcaagatttttaaaagaagacattaactagtgcctgccttggcctacctctgatcctatcttttttatgcattaattaccatattgaaatgcaatttattcatttttcatttacctttgctgtgcccaaattcttcatctttgagatgttgattgttttaccctttgacaggcatttctgccttcttcctatgagttgatgtctagacagataacagttattaaaagcttgggaaatgattgttatcctaggtaggctggtgcagggtttgttaagaagtaaacattctctgtttaagcttgctttgaaaaatataactcatttgtcactcatttaagatggaaattgagttcttggtgaaaatgtcactcgagaaaatggaagtatggggtacctaagtgtcatgaatggctggagtcttgctggggaagggataaagcaagtctttgggtactctaaaatgttgataatcagttgtcaaagaaatattaattgattgatgatattaatgatgttcttacggccataacattggtgggaaaggggggtaaattatttttaaactgatatacccaatcctacttgcaaagaaattgactagagacaggcttaaagtttgagatttctcaattatgtcatgttttatccagaaaccactattgccaaacagcaaatgttattaatatgtgcttatttaatttagaaaagtgtacatcaatctaacctggaaaacatggtaaaggccatcctttaccatgtcatctaggatattatctatctgttttatatgtctgccttcttatctatatgaaaaaaactcttgagtgcctgaattattttaacatgcccttacctatgcacccactaaactacttctactcagagtaggtgttcaataaatgtgaaagtgattaatcaggtaattcaagaaaacagagtggtgcaaaatcatggaggctaaggagtgataaaagggtccttgacttagtggccatgcaatcatgttttcctctggcttcttcattgttaggcctcctagaccatgtttggagagaatttcactgactccaggacttttggcactactctggagataagaacgttcaggaaacatactgatcactttccaaacaccctcagacctgctgcttaatagccacctgaaaaattctttaattttaatttctcaccttcccggggatctctttcctggatgataggaggaggattccggggaagacttcaagagacaagcctggaatgagctgcttgagagaaacagaagggttgatcctgcccagcttagggaagacattgttggagaagatttcactactcagtcattcaatgaaaaaatgaagaccatccccaacccttgatcatctaataccacttttgtcctacagaggggcatagctttcagcaagacattcgtcatccaacccattctctgcctgatgccttcccattctttcttattacttttgaggggcttaaatttaaaagggtagcataatggagcttttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacataaagtatatgaaagtaatattttatttatttatttttttgagacagagtgtcgctcttgttgtccaggctggagtgcaatggcgcaatctcagctcaccacaacctctgcctcccgggttcaagcaattcttctgcctcagcctcctgagtagccgggattataggcatgtgccaccacacctggctaattttgtatttttagtagggacggggtttctccttgttggtcaggttggtctcgaactcccaacttcaggtgatccacccatctcagcctcccaaagtgctgggattacaggcgtgagccaccgtgcctggccatattttattaacatgagttttttcataggttcatatgcatgatatttatatattattttcagtacaaaaaaatgaaactaggtactaagattgacagtcgtagtcttttgttggtgtataattcaacttgatcctgcattttttttctacacagtattgaaaaataaaattcacatctctgtagtaagtgcaaatggctgcagattttttgtcgttttaataagtgatccataagcttaaaagaatagtaacagaaaaaaaattgtgtggactggtaaaagctacttagcttgctttctttctttctttcgttctttctttctttctttctttctttctttctctctttcttttctgaaacaaggtcttgctttgtcacccaggctgaagtgcagtggccttgtctccactcattgcaaacagcaacctctgcctcccaggcccaagcaatccacccacctcagcctccctcccgagtagccgggactataggccatgtgccaccacacttggctaatttttaaattttttatagagatgaattctcaatatattgccaaggctggtcttgaactcctggactcaagcaatcctcccacttcagccttcccaagtgccatgattacaggcatgagccaccccacccggcctacttagcttctctgagccttggttttcctgtttgtaaaatagcaatcacaatagtacctgtctcaggggggtttgagggttaagtaagacattgtatgtaaagtctctaaggaatttggcagacttttcagaatgcttggcacataagcaatcagtaaatactaactggtactaacgcgatcaccaccaccatcagcagcagaatccatttgaattccgtaaatcatacagcaggaaaattggtaagtagattccttagctcatttcatcttcattgtttggtgggaaacactttttcaaatcaatcttacaatattgtaaaatgcttaaccttaaatgcccatctctatcagatactaactctaggtcctgtagtacataatttggaaaccactggtgtagaagtctgaccaagtttctgcaaagattgcctggtagattatgagctctttgagagcaggggctattttatttatctgtgtattctttctgttgcctgagacagcagatgctcaaaaaatatttcttagattatattcaggttcatgtctatagattttaaagaagcttactattacccctaattacctttccatttaaaatcaaattttcttttttgtcttcctctacattttctccaacattactgtaaattttaaaaattatcccctgaatcaagagtcccaaccttttggtggtaaagagttcctcagttcctcagttggaacttccaggttatgaaggccttaatatcctctgaagaaggaaagcaatttagcattaatctctcaagggagaggcaacaaacatttgattttagacttgacagtttctggttataaaagttgcttttagcaaccatataaaagtcattagcagtcataacaaagccgttctattacatataattcgctcccagagttgagatttctggtagtaaaatcacagacgccataaaactgtggcagttggctgttaatacaacctgtccttatgttctagaaggcaaatttagattgccattgcttaaagaattacagaacttctaacttcttgcctccctttcttcctttctttcttccttccttccacaatcattatatcaccatcacccatattagttcttgccctcaagtagttaaaattctagcaaggaagacagacacacacaaaaaaatgccttcacatttattgcatggcagtctaattgaaatatacaaagtatattataaaagcacagagcagtgaagcaccaaaagcagcattagtgggatatcctaaaggatagattggagttatccaggaaaaggggtgaggatggaaagaaagactatttcaggcataggttgcggcattgaggataaagccaggacaagatacacctactatgtacccacaaaaattaaaaagtaaaaagtaaacagggcaagaaccagcatggtgtgtgtggaaaactccaagtagttcattgttagagaggcatgaagtgccaggtagaaactgatgaaaaacaagcctagaataggcaggtaccagatcaaggaggaccttggataacagataacataaaaagcctgaaatgtatcatgtaagtgatagtgatctactagaagattctagtataatggtggataccggaaggttagtagaaatgttgggtgacaattttcctaagaagtctggtaagtaaagggttaagataaggtcaggaggaagggcgaggattgtagaaatggagtggaaaaaacagattcatgggcttggtgcgctggctcacacctataatcccagcactttgggagtccaagttgggaagatggtgtgggtccaggagtttgacaccagcctaggcaacatagtgagacctcttctctacaaaaagttaaaataaaattagccaggcattgtggcatgtgcctgtagtactagctactcaagagtctgaggtgggaagatcacttgagcccaggacgtcaaggctgcagtgatccaagatcacccctctgtgctccagcctgggcaacacagcaagaccctgtctccacaaaaaaagagataaataggaggtaaaattggcaggatttcataatttagtgcacatagggtaagggaaagaagaattattaagaaatgtctatcttaggtttcctgcttagtgatatcaatgacagtggaagatggagaaatttaggaggagttagacttgacatcagctttggatgtaagtttgagaagcctgctctcccttggtccatgcaagaggaattaattataaggcaattggaaatactagttcttggtagaggtttggcccagatatagatatgggaatgatgggcatattgatgatagttgaaactaactataggaatggatgggtttactcaaggagaaaatgtagcatgaaaagaacagagatctgataatggagtccaggcataacatcaacatttaataaatatttcttgagtgcttacaccaaatataggaaagccctgacctaaaggacttcacaacctagttaacaatgatactgaatttctggccgggcacagtggctcatgcctgtaataccagcactttgggaggctgaggcgggcggatcacttgaggtcaggaattcaagaccagcctggccaacacggtgaaaacccatctctactaaaaatacaaaaatcagccaggcctgtaatcccagctactggggaggctgaggtacgggaatcacttgaacccgggaggcagaggttgcagtgagccgagatcatgccactgcattccagcctgggggaaagagggagaactccgcttcaagaaaaaaaaaaacaaaaacaaaaacaaaacaaaacaaaaaaaacccatgatactaaatttcaaactgcttctcaaagtgccaggtttctgaggaggtgcagaggataaggaatagactgagcagtctttcactcatgctttaattagaagagcttcacttctacgtgtgtgtgtgtgtttgtgtttgtgtgtttctttttccattgtatgtttgttttgtgtggggggtagatgaggttgctgttgttaaaaaagagaagtttgacaaccattgtgctaaaaatctgatttaaatatagtaaacaaaatattcaagatgaatacctggctcaaactctacttttggtgaaaagaaagggattaaatcaatttcaaaaattggcaatgatatatggctggtgttcagttctatttcactcacttcagcatcattcaatcatcatacattactaagtatgaaagaatagaggagaaattggaatacatatttgttaggagatgcatgccagatgaggtattgagtacatgaagcaggtaaggtagatttttaaatattttgctactgactttggatatgatgagatgaacagttagaagccattgttctccaatagacttttgccttaatgtatgttttagaataaatttaaccatatcactgatcacatataacacatgaggtgaattgaaaattagcattcctaaaggatgaaatttctacaaatcaaaacttccgcagggatgttggtcaatgcttcttttaaaaccgaggatatagataatttgtatatgggagtgatatcctctgtctcccctccatgccactctaataactaagcaacaagatttatatcatgtttagaatttatcagtagaataaataagtccctggaagtcaaacatataaggataatcaatgttatcatcatctgacaggagagattaataggatttgtatattttaaaagtgaaaagtagtcatttttatttactaaaataatatgtcttagtctgtgttgcactactataacagaacaccacagactgagtaatctacaaaaggcaacaatttatttctcacagtattggaggctgggaagttcaagatcaaggtgcagaaatatgggagttgcactgaggggaaaagcctatagcagttctgctttcaattgttaagacttggaatagcagcaaggttgaggggcacaaagaaggagcctctgaatctaagacccccttattaaatcaggacacgtaaagagagcaaatggtcccagatcgatagtgttcttcccttccagtacaagcagacaagaatattattttaaaatccccaatttagatatacagttttacagcagattatgaagcagatctttgattcacaaatatcaaagatcaccaagtactgaggaagtaagtcaccataaacaggaatcagcaaaaacaataatgagcagatttatatccctaaacgctttatttagaatatttatgtatgatgtgttgaaaaaactagggatatattccaaagatgagctatcaaacaaaaagagacaaatatgagttactagggaaatctgcaaaataactaaatggaacttctagaattgaacaacgcatttattaaaataagaaatgcagtgaatggttaaaaacaaaaataaagagcaaattggggaactagaagaaaaatctagaattatctacaatggggatagaaaaacaagagtagcaatattaaaaaaataagagatgtggagcacagaatgcaaatacttaactcatattgaattagagcgccagaaggagataatagagggaattgaggagaggtattatttgtatacataattatgaagaatatttcagaatttattaaacatatgaatcctcaaattcaggaaatacaacacataccaaaacaagatgagagagagagagagagagagagagagagagagagagagagagagagagctaatctttgcatagatacattgtggtgaaactttaggacaccatcaagaaaaagatcttaacagcagagggacagatcacatagagaagaacaacaattacactgaaagcagatcacttaccgatcgaaatggaatgcaaaatttaatgcaatgcaagaagaaaataacaaatctgctatcttagaggaagatttttaaacacctcattcaattatgaatacttcaagcagataaaaaattagcaaagatatagaatatttgaacaacctaagtacaagcttgatatagtaaatgtttatagaacactatatccaacagttagagaatacatattcttctctagcagacatggaacatacataaaaattgagcatgtattcggccctaaagcaaattacaacagaatttaaagaaatccatacgtctagaacatgttttctaaccatatgacgtcaacaacaaaaagataattttcaaaatccctatgcatttagacattgaaaacacacataatattataataaaaattaaattttagaattgaatgataacaaaaatactatatatcaaaacttgtagcatgtaatgagatttatacatggaaaaatgtatgttattcaattcttataataagaaaatgaagactaaaaattaatgatatagatattcaacttcagaagttagaaaaagaaaaacagaacaaatcctaaaaagttgaagaaaaagttaggaggagaaattaattaaatagaaaacaaacatgcagcggagaggatcattaaagtcaaagttggttttctgaaaagaataataaaactgaaaaacctctggcaaggaaaaaatgtcgcaaataatatcagctattaaaaagaagatataactatatatgctctggatattgaaaatatgataagaggatgttgcaaacaactttatgccattaaattttgcttaaaataaaatagacaaattcttagaagaataacgattaaagaaatgcattctgtagttaaagttatactaatcttttatgaaacagattatctcagtctttatacagattttccagagaatagaaaaagcaggagtaccccaccaacttattccatgagatcagtataactttaaggggaaaaaaagataatggcaaaaagagaaaggaaaattactggccagtttcttttatgaacataaatgtaacaatcctaaacaaaatactaggaaagtaaatccagtaggatataaaaaggaaaatctatcatgacatgttgggttaatctcaggaatgtagcagtggttttaacattaagacatgcataaattcaaattacaatatcaatagattgaaggaggaaaaatatacccatctcagtagagagatttccccacaatagtacatggataactccctggcaattcacttgacctccatagtggatgaaacattttaaaagcaataagctgtgagttttaggtcttggttttcagtttggttactccctgttaacatgtaaatgctgcaaatttttattttagttaaaaataaaacttatgttgcctgattacaaaataatatacctgcattgtagaaaaatggaaaaatgcagaaaagaataaggaagaaaagtaagagtacccacccataattccacaatttttaactttttcagttcatatccttccaatagattttatgtatgtgtatatatttgtattgtaaaggaatgtgaccatactgtacatattatgctatcgtaacctattttcatttatcagtatcatgaatatatttaatataatctccctaacagccttatacatcacctattaatgaccacattttatcatattaaatagatattatattttactcccatattgttacacattttaggttgttttcaacctaagttcttgaaaataatactgtgattaacacttttatagctgaggctttatacttacttattttccttagggaacataactacacataaaattactatgtcaaaggatgtgcacatttttaaggactcaagaaatgactattttcagacacatatctaaatatatatatgaacttaataaatagtgaaggtagcacctcaaatcagcttttttggagatagttgacagtaattttgaaaaagtgaaatctgtattgcatacaagacaccacaatatacatcgggtataataaaatcttaaatgtgagagacaaaaccttgaaaaattctacaagagaacatagagaaatattctcatataagtgtggaatagggaatgactttctaaattctaaggatgttataaagcctgaaaggctaaagaaaattcttgatacctttgaacactttctaaattttttgtgtcaaaaatagttcatggaaaaaatagtaggcaaatgccacatttgggcaaatatttacaacgtgagtaaaagaaaggcttaattcattactatataaagaaatgaaggctatcttttatctgtgcatttatatttaaacacacatacacattcatacacatacacacacacacacacatacatacatacatgggcctttttcaaaaaacagaagataagactttttcttttgtcctttttcacagtgggagctggaaaagagattttctgaaaccagattgtaaattgcaaaaggcatttttctctggggttcaggtgagatgaggcagcagtttcaccctgctgtatttggaccctagatagaaagcatattccttttgtcattgctctgagatgcagctctagccttgagctaagagcaaaaataagtgagctatgaaaatctgggtgtgactactaaaatgctgataatttaatctattacaagcaaaaatgagtaatgagatagtaccatctttatgtgatttatggccaaagtttttaacattgtagtaaagaagtctcttattttaagagactctgaaagagcgaggagagagggaaggaaaggagggagaaagcggaattaaatgacaaacctagagacttctatttcctgggggtagtaacagcaaaatatttgcccagcagtaaagagggcaaagaaatcacttcttagagaattgtctaaagacattttttcctagcaaataataatctctacaaaccttcacctcataataaaggaggctcagtactggccttcggaaaagaaaagttttattggcagccatgtagtctgaatacagagtctgatagaaatcataaagcatgtcttgactggtagtcatgatgacagcaatagaatggctttcaggcactaaaaggaacacagtaaactccctgaaattagccatctccactgtctttttcaatgtgagactgacaatacttagtttacaattcagtgtgatctccatgttaaacaagtaggaaaatcagagtaggctgggaattttggaagcttctgcattatctgggtttatgttcttagatgggcttttctatagtccctttgcattatcaaactttcaaaatggttaataatgaaatatactaggatgaatcattggattattcaatggtgattaaaatctgctgctttccctgggtgtctcatcttccttccagccctagcattttgtgtgttgaaaagaacattgcctgaagggaaaacacttgcacaaacagtacacttggaaacaatccaactaaaaacttggaggcatgttcctgacccaaataggaacatatcctattgtctttttgccccagttttccctgatttgtagtatttaaagagttgctgttttgaagaaattacagtataatttataccaatctagaatgtaaatgtaattggacaatttacaaattagataggtctagtactaatgaaaggcacaaaataaaaaatcttagagtctatttgagaccattaaccagggcagaatctaacatagtacattgaacttagtgggcatttcatacgtgtttgttaaattaaactgaatgagttcgtaaaacagcattctctctattactgccttgctaaaaattcttgcatggtttttcatttatgagaaatccaagttcaactcctcctccccttctgtacccagcagtagtcagcagctttatttcatactacctacttatgtgcctccttcaccatggccagcaaaatagatataatgcctcccaagactttgactggccatactacaaaaaggatgctctcccttcaatttatccaaacacttcacagccttctacttacagcatggattccacatccttctgcttattctgccctgacactctagcgccaaagtatttattgccacttttctcttttgtctttccctcttgtttgactcttaccaagtatacttattggtttctccaaattcgcaattttccagtctttttttctcagattgtcaactcttagaagtgagaagttcctagcatatatctctctgtacaccctacctcttttttctgggttcttaatctagggtcttaatcaaggaaggcgatcccttaacggtctgtggatagaactatatttcaatgtaacctacttttttggtaatcctataggtcctattttagttttgaattttttcattgaagtagaacatccatctagaaaagtgcacgaatcataagtgaatttttgcatgatgaatagaactgtataactaccacccagaacaaggaacaagaatgttaccaccactacagaatatagaacctaacacatcctgacttctgacaccatagatcagttctgtatgttcttgaactttaattagtaggaatcactgttatgtgtttagtttatgcatttaaggaattgttctgagaagatgtccaaaacacacagacacacataaattttaaaaggtacagaaccatggacaaccttttaggctttcccagatctaagatttctgagtttgattctttacataaaatgagggggaatttgcagaagtaattgcaaaagtaaagtgactcagaatcagaatctgataatgcctaaaatagatgggcagtgccaaggatttgcgaagattgattcatcattagtcagttcttgccgtgagggtagggtggggcgagtactttttgacctaccaaatgagctttaactattttaacatatattgctcacggctttgtgttttactctttaacaataattttaagaatagtcagctgttttgtggactaaactctcacatcgtctaacacggggtcttgagtgtaaaaagaactcagtaagtatctgcttaaccattttgtgcttcagtatctgcttggccattttgaaccacaatgtcagctaattagccttttcaaaaaggtacatttttgtctaattggtagtttctaccagacttcaatggaattcctttgcttggtatcagctatagaaagatgtgtttgcactgagggtggacaacactacagcaaggacctacatgtgtaggcagagactgatctaactaatcagtaaaaactgcaaatgagcatcagttccatacaatgtctttgtgatatgattacatcagtatacctacttctccatatgtgtttttttttttttcagggagttagatggctcctctctgcttgttctttttgcctaatatttttgttgtcctgaatatcttccattaattgaatgtcatgtttttattgcttacttgaatgcatacagcattcaagggctgtggcagatgaaaaagaaatagaatgtgctggtctaaatcacctagtaatttaatgactagtttgagaaacaagacataaaaagagataaacaaaagtgcacgcctgactatatttaagcaataaatgataaagacattaacaattgttgattgttaagtgagtaacccacttttggagaggatgaggaaggcctcaaagaacagatcatcaccatcatagctaattcataatttctatgtagaataggcttagggtatagcaatctgagtagaaggaagggttgagggacttgtcctgaaactgcatttacattaacaaacatactgttcttatgtagattatatgcttatttataatggatcttgaagaatacttagggcctggcttagtgaaggagagaaaatcttcttggttgaagagtcccaatctactgtgtgtataactgaatttgtggaagatacgatgtgtaagacaaggtttctgttctcaataatgttgtaacctgcatggagaggcaccatatacatgaatagaaagtcattacaaatagaaataattttgagataaatgtcatttgcaagtgctaagtgatcaaaggagaaagagaggtcagcatttgccttggtggtcagggaagccttcctgggtcaggtgaaactttgagctaggccttgaaagagacatagaaatcgaacaggcagagaaagggagctcatgtcaaattacattgattgtcttccctgacttcacagtcagcactgaatgaactctcttcctgtgactcaccttctgaatgacatcattttataaatcttaggtgcatcatgacttgcgttacttttgaattggaagtgttatctccccaacagcctgtggaatgattatttagcactggcaggtagtgctgcatcatacctttctgttctgaaagagttaacagagcttctataggtatccaaccagaagttcaggcactggacctagactttagataacagaaatgcctttgtgctggagtacacttaatgagagagagcacctctgtcccgacacatttgatgaattcactcaatttgggaaaacccagaccagcgcacagacactaagatgagaaaagaaaaggtttcgttcaccttcttcattccaaggttgtgaattcattcttgggaggccttgaaaagggagggtggaaagagtaggaggaggagtggaggtgggggatacggagtttctgacctgaattccacaacagaggaatgtgtgaacagcaagagacacaggtacaggctagtgctctcacatacctgaggaaaacagattttacccaacttccactctgtccactctgcagacagttgacagtgtggtaaagagaattaataattctatataattattttatttaataacttatttttatttactaattttatttgttattatttattaatatgttttatttcccagagtttagggagggtaccgtgaaaaaggagagagaattaacattttaaaacacttaaacacaaaaaagaaattggctgtagaatgtccaaagtgaacagtttaatgctgtttaaagcggtcctggatcagccatgtttaaatgaggtatatgaagaacaaaaatcatgcttgttctgattcgtcataaaactacaaggtggttaactgggagagaaaatgacgtcagcccctcttattatgaagccctttgggaaagctagttagatgtattttttactatctttgtgagagacccttgggacagaagttagtttcagaaaatgcaaaacatccacagggacaatcatagtacatttgttcacattgccatgcaaactgtaaaggcaaatataaactataattcagggcacatagaaaagttaaggaaacatgggaagttgattctcctgcttaataagactgacaggataaaccaaagtcaaatcatttatattttataagctgtaatgttttctagatattgggttaaggaaaaacatgagatacctgcagttattgcatcaactcattgtaatttttgcttatagttcttttcttttgagattgataaatattatctgtggagatttttcttctcacctaaagaaagttcctttggctgatggggcacatttcacggtatacacaggatctgctgtcatagagaatagccctataaaccctcaaactgataagttatttcaactttcaactgtgagtcagaatctgatgctccagaggtagcatgtggaagatcacacagtaacacatgtttagcttttgatgaagagctttataaactttgctaggaaaaggtactcttgcccttgatctttcagtagtgcattgagtgacaaagacaagcaatagtaaattggttggggtggagtggaatggtgatgacattaatataaaaacaaacttcactgaatactatgtaagtataccatcctagagaaagtggtatatggcaacatagaatctcagaacctgtattcatatggattatttttattattaatttttattgagtaataatatacattcaatgaaatataaaaaaaaaacttaactcttctgcttaatatataaaaccacctagatcaagatatagaacatttccagaattgcaccagacttgcttctaacttctatcaccatagattactttttgactcttcttgaattcataaaaatggaattacatggtgtaaattcttttatgtctagctttttgttatcatctgtaagattgttgctagtagcatttacaattacttttaatgcaaattgatcagtgaacaattcagtgattccacaagtagacgataaatgccttctacatgccagacattgtgctaggtgctaggaattcataacccagttatatatggttcctgccttcaaggaactaacagctttagtggaaaagatgaacaggctaaaaataagaatatagccacaccagctttttttgtgattagtatttacaaaagatacccctcccatctttttattaggtttggtgcaaaagtaattgaagttttcgccattactttttttttctttttctttttcttttattattatactttaagttctggggtacatgtgcagaatgtgcaggtttattacataggtatacatgtgccatggtggtttgctgcacccatcaacccctcatctgcattaggtatttctcctaatgctatccctcccctagacccctacaccccgacaggccccagtgtgtgatgttcccctccctgtgtccatgcactctcatcgttcaactcccgcttatcagcgagaacatgcagtctttggttttctgttcttgtgttagtttgctgagaatgatggtttccagcttcatccatgtccctgcaaaggatatgaactcatccttttttatggctgcatagtattccatggtgtatatgtgccacattttctttatccagtctatcattgatggacatttgggttggttctaagtctttgctattgtgaacagtgccgccataaacatacgtgtgcatgtgtctttatagtagaatgatttataatcctttgggtacatacccaataatgggattgctgtatcaaatggtatttctagttctagatccttgaggaattgccacactgtcttccacaatggttgaactaatttacactcccaccaacagtgtaaaagcgttcctttttctccacatcctctccagtatctgttgtttacttttaaagttactttttattacttttaaaggtgaaaatcacaattacttttgcaccaacctaataatttcaaccatgctatgactttatagttatttggtgacagctttattgagatgtaattcacatactgtaccactgaattcacttatttaaagtgtatagttcaatggtttttagtatattcattggtgtttataactatcaccacagtcaagtttggaacattttcaccagctcaaaaagaaatcccatagctgtgggcaatgatccctctataactttatctccccaaaccccaagcaaccactaatctgctttctgtctctatagatttgcctattctgagcatttcatataaatgaaaccatacagtatgtagtcttttgtaaatggattctttcacttagtataatgttcttagtgttcattaattggtagcatgcatcagtactttattcctttttatggttgaataatattccaatgtataaatataccacattttgtttatccattcatcggttgaaggacattatgattcttttttcactttttggctattatgaataatgttgctatgaatattcatgtacaaattattgtgtggtcatttttttcctcttgagtatatacctagatgtgaaattgataggtcaaatcacaattctacataaactttttaaagagctaccaggctatttttcaaaatggctgcaccattatacattcccatcagcaatatactaaggtttcagtttctcatatctttgtcagcacttgttatctcttttattatagccattgtcttagtctgtttgggttgctgtaacaaaataccataaactgggtggtatataaacaacagaaacttattttacacagttctataggctacaaaattcaagattaaggcatcaacagattcagtgtgtgatgagggcccactttctgtttcatggacagtgttctcactgtgttctcatgtggtggaagcaatgaacaagctttcttgggccccttttataagggcactaataccatttatgaggtttccactctcatgacctaatcacctcctgaaggccctaattcctaatatccttaccttgggggttagaattttagcatgctaattttggggagactcaaagatccaagtcatacacaacatccattctcatgagtgtgaagtggtatctcattgtagtttttatttgcacttccctgatggctaatgatattgagcatcttctcatgtgcttatcagtcacttaaatattttctttggagaacagtttttttttttttcagatcatttgtccatttttaattgggttaattgtctttttgatgtccagttgtgagagttctttatctgttctagattacacgctccttatcagatagatgatttgcaaatattttttcccattgtgtgggttatcttttcaatttcttgatagtgtcttttgaggtatgaaaatgtttaattataataaaatccactctattctttttcttgttgttcatgcttttggagtcatatacaagaatccattgccaaatttgaggtcctaaatatttatatgttttcttctaaaagttttatagttttagcgcttacatttagggctttgatccattttcagttaattattacatattgtgtgatgtagcagtccgagttcattctcttgcatgtggatatccagttgttccacgccatttgttgaaaagacttccttcctcattgaatggtcttggcacctttgttaaaaatcaactgaggcgggagagctggcaagatggccgaacaggaacagctctggtctgtaactcctagcaagattgatgcagaaggcgagtgatttctgcatttccaactgaggtacccggttcatctcattgggactggttggacagtgggtgcagcccatgaagggcgagccaaagcagggtggggcagcgcctcacacaggaagcacaaggggtcgggggatttccctttcttagccacagtaagccatgagagactgtactgggaaaaacagtacaccctggcccagatgcagcacttttcccacagtctttgcaaccagcagaccaggagattccctctggtgcctggctcggggggtcccaaccccacagagcccaacaagctaagatccactggcttgaaattcttgctgctagcacagcagtctgaggtcgactgggagcttggtggggggaggggcttctgccattgccgaggcttgaataggtgattttaccctcacagtgtaaacaaagccaccaggaagttaaaactgggtagagcccaccacagctcagcaaggcctcctgcctctctagattcctcctctctgggcagggtgtctctgaaaaaaaggcagcagccccagtcagggacttatagataaaacccccatctccctgggacagagcacctgggggaaggggcagctgtgggtgcagcttcagcagacttaaacgttcctgcctgtcatctctgaagagagcagcggttctcccagcacagcgtttgtgctctgataagggactgactgcctgctcaagtgggcccttcacccttgtttatcctgactgggagacacctaccagtaggggcagacagacagctcatacaggaaagcgctggatggcatttggctggtgcccctctgtgacgaagcttccagaggaaggaacaccatctccactggtgatacccgggaaaacagggtctggagtggacctccagcaaactccagcagacctgcagcagaggggcctgactattagaaggaaaactaacaaacagaaaggaatagtatcaacatcaacaaaaaggacgtccactcagagaccccatccaaaggtcaccaacatcaaatccacgaagatggagagaaaccagcacaaaaaggctgaaaattccaaaaaccagagtgcctcttctcttccaaaggatcacaatgcctcgccagcaaggaaacaaaactggatggagaatgagtttgatgaactgacagaagtaggcttcagaaggtgggtaataacaaactcctccgagctaaagatgcatgttctaaaccaatgcaaggaagctaagaaccttgaaaaaaggttagacaaattgctaactagaataaccagtttagagaagacataaatgacccaatggagctgaaaaacacaacatgagaactttgtgaagcatacacaagtatcaacagccagaatgatcaagcagaagaaaggatatcagagattgaagatcaactcaatgaaataaagcgagaagaaaagattagagaaaaaaggatgaaaagaaacgaatgaagcctccaagaaatatggaactttgtgaaaagaccaaatctatgtttgattggtgtacctgaaaatgatggggagaatgaaaccaagttggaaaacactcttcaggatattatccaggagaacttccccaacttagcaaggcaggccaacattcaaattcaggaaatacagagaacaccacaaaaatactcctccagaagagcaacctcaagatatataattgtcagattcaccaaggttaaaatgaaggaaaaaatgttaagggcacccagagagaaaggttgggttatccacaaagggaaccccttcagactaaaagtgggtatctctgcagaaaccctacaagccagaagaaagtgaaggccaatattcaacattcttaaagaaaagaattttcaacccagaatttcatatgcagccaaactaagcttcataagtgaaggagaaataaaatcctttacagacaagcaaatgctgagagattttgtcaccaccgggcctgccttacaagagctcctgaaggaagcagtaaacatggaaaggaacaactggtaccagccactggaaaaacataccaaattgtaaagaccatcgacgctgtgaagaaactgcatcaactaatgggcaaaacaaccagctagcatcataacgacaggatcaaattcacgtataatgatattaaccttaaatgtgaactagctaaatgccccaattaaaagacacagactgacaaattggataaagagtcaagacctatcagggtgctatattcaggagacccatcacacatgcaaagacacacataggctcaaaataaagggatggaagaatatttaccaagcaaatggaaagcaaaaaaaaacaaaaacaaaaagcaggggttgcaatcctagtctctgataaaacagactttaaaccaacaaagatcaaaagagagaaagaaggtcattatataatggtaaagggatcaatgcaaaagaagaggtaactatcctaaatatatatgcacccaatacgggagcatccagattcataaagcaagttctttgacacctgcaaagagacttagactcacacacaataatagtgggagactttaacaccccactgtcaatattagacagatcaacaagacagaaaattaacaaggatatccaggacttgaactcagctctgggtcaagtggacctaatagacatctacagaactctccaccccaaatcaacagaatatgtgttcttctcagcaccacatctcacttattctaaaattgactacataattggaagtaaaacactccttagcaaatgcaagagaacggaaatcataacaaaacagtctgtcagaccacaatgcaatcaaattagaactcaggattaagaaacccactcaaaaccacacaattacctggaaactgaacaacctgctcctgaatgactactgggtaaacaacgaaatgaaggcagaaatcaagatgttctttggaaccaatgagaacaaagacacaacataccagaatcactgggacacattaaagcagtgtgtagagggaaatgtatagcactaaatgcccacaagagaaagcaggaaagatctaaaatcgacacactaacatcacaattaaaagaactagagaagcaaaagcaaacaaattcaaaagctagcagaagacaagaaataactaagattagagcagaactgaaggagatagagacacgaaaaacccttcaaaaaatcaatgaatccaggagccagttttttgaaaagatcaacaaaataaatagactgatagccagactaataaagaagagaagagagaagaatcaaatagacgcaataaaaaatgataaaggggatatcaccaacaatcccacagaaatgcaaagtaccgtcagagaatactataaacacttctacacaaataaactagaaaatctagaagaaatggataaattcctggacacatacaccctcccaagactaaaccaggaagaagtcaaatccctgaataaacgaataacaagttctgaaattaaggcagtaattaatagcctaccaaccaaaaaagtccaggaccagacggattcacagccgaattctaccagaggtacaaagaggagctggtaccattccttttgaaactattccaaagaatagaaaaagagggaatcctccctaactcattttatgagcccaacattgtcctgataccaaaacctggcggagacacaacaaaaaaagaaaattttagggcaatatccctgatgaactttgatgcagaaatcctcaataagatactggcaaaccgaatacagcagcacatcaaaaagcttatccaccacgatcaagttggcttcatcctggggatgcaaggctggttcaacatacacaaatcaataaatgtaatccatcacataaacagaaccaatgacaaaaaccacatgattatctcaatagatgcagaaaaggccttcaacaaaattcaacagcccttcacgctaaaaactctcaatgaactaagtattgatggaaactatctcaaaatagtaagagctatttatgacaaacccatagccaatatcatactgaatgggcaaaaactggaagcattgccttttaaaaccagcacaaggcaaggatgtcctatctcaccagccctaatcaacatagtattggaagttctggccagggtaatcaggcaagagaaagaaataaaagatattcaattaggaaaagaggaagtcaaattgtctctgtttgtagatgacatgattgtatatttagaaaaccccataatctcagaccaaaatccccttaagctgataagcaacttcagcaaagtctcaggatacaaaatcaatgtgcaaaaatcacaagcattcctgtacaccaataacagacaaacagagagccaaatcatgagtgaactctcattcacaattactacaaacagaataaaatacctaggaatccaacttaaaagggatatgaaggacctcttcaaggagaactacaaaccactgctcaaggaaataagagaggacacaaagaaatggaaaaacattccatgttcatggataggaagaatcaatattgtgaaaatggccatactgcccaaagtaatttatagattcagtgctatccccatcaagctaccattgactttcttcacggaattggaaaaaactacttcaaatttcatatggaaacagaaaagagtccacatagccaagaaaatcctaagcaaaaagaacaaagcttggaggcctcatgctgcctgacttcaaactatactacaaggctacagtaacaaaaacagcatggtaatggtaccaaaatatatatagaccaatggaacagaacagaggcctcagaaataacaccacatatctacaagcatctgatctttgacaaaccagacaaaagcaagcaatggggaaaggattccttatttaataaatggtgttgggagagctgtctagccatatgcagagagcagaaactggatcccttccttacaccttatacaaaaattaactcaagatggattaatgacttaagcataagacctaaaaccataaaaaccctagaagaaagcctaagcaataccattcagagcataggcatgggcaaacacttcatgactaaaacaccaaaagcaatggcaacaaaagccaaaatagacaaatgggatctaattaaactaaagagcttctgcacagcaaaagaaactatcatcacagttaccaggcaacctacagaatgggagaaaatttttgtgatctatccatctgacaaagggctaatatccagaatctacaaagaacgtaaacaattttacaagaaaaaaaaacccatcaaaacgtgggcgaacgatatgaacattcacttctcaaaagaagacgtttatgcagccaacaaatgtatggaaaaattgctcatcatcactggtcattagagaaaggcaaatcaaaaccacaatgaggtaccatctcacgccagttagaatggtgatcattaaaaagtcaggaaacaacaaatgctggaaaggatgtggagaactaggaatgcttttacactgttggtgggagtgtaaattagttcaaccattgtggaagacagtgtggctattcctcagggatctagaactagaaataccatttgacccaggaatcccattgctgggtatatacacaaaggattataaatcattctactataaagagacatgcacatgtatgtttattgtggcactgttcacaatagcaaagacttggaaccaacccaaatgcccatcaatgatagactggataaagaaaatgtggcacatataccccatggaatactatgcagccataaaaaaagcatgagttcatgtcctttgcagggacatggatgaagctggaaaccatcattctgaggaaactatcacaaggacagaaaaccaaacactgcatgttctcactcataagtgggagttgaacaataagaacacatggacacagggaggggaacatcacacactggggccttttgggggggtaggggtctaggggagagatagcattaggagaaatacctaatgtagatgaggggttgatgggtgcagcaaaccaccatggcacatgtgtacctatgtaacaaacctgcatgttctgcacatgtatcccagaacttaaagtataatttaaaaaaagaaacaaaaataaaatcaattgaccaagatgtatgggtttatgtcttaagtctcaattctatttcattgatctatatctctgtccttacagtggtaccatactgtcctgattattgttgctttgaagtaagttttgaaaggaggaaatgtgaatcctccagttttattcttatttttcaaaattgatttggttaatctggaaaccaaccaattccatggaatttgaatcagctgatcaatttctacaaagaagccatctgggattctaatagggattttattgaatctataaatcagtttgagggagtattgccatcttaaagattttgccttctgatctatgaacatagtcgtgttttttatttagattttctttaatatctttttaaaaatgttttgtagttttccaactaagttttgccttttttgtcaaagtaattcctatatatttaattctttttgatagtactgtaaatgtaattacttttcgtaatttcatttttaaattgttcattaccagtgtacagaagtactatcaaaaaggcaaaacttagttggaaaactacaaaacatttttcccattctatacacatactatatttcccattcatatagtatatatgactaggaaaaaaaatagtatatataagaattggtactatctgaggtttcaggcatccaactggggtcttggaaaataccacccatcccccacagataaggcggtctactgcatacaaagtgatggcatgctaactgtgacatttgatccttccaaaaatacactgagtaattgggatcattgccacttttacagccagcaaagttaagtcaagcaggggagcaaagtcttggtgtaagttttgaaaacattctgaagtccaatattttttccctttagattccccatgtgaccttagacaagttatttgactctccaaatcttatttcctcatcttaaaatgagagcagttgagagtcgacatttacgtttcctttattctctaatattccattatttttgaattatcctcttttgaggtgtccttctttctttccatatttcaaaaacaattatgttctctctcatgcctaccaagtaggattctattccctcagaatggaaaagcttgccactatgagccagatccccaacacagtgtgtatccctctcatgcaatagtctccaaacaaaccagtttacattagtaactgcacgtaaactggaattaactcagagatttcccctacgtgcttcccaggtgttttcctcattgtttgagataaaacagtcattcatatttgcctgtttcttgaatctgtgcctacattcattgccttgcccctgccaagttgaattttgcctaaggaaaatgatgtttggtttttcacagtaaatcagatggatggatggagagttaagatgaatagctggaaagatgaatggatggatgagaagatcaaagaatggctggagggccagaagaatgaggagatagatgtctgggtggatgggtagaggaataagtgaatgggtaagtggctaagtggttaaaagtatagaggataaaaaggatagagaaatggataaatgggtagagaaatggataaatgggtagatgaatggatgagtaggtgggtaggtgggtaactggatgaatgaatgcatagacaggtaaatcaatatgtaaatataagtaaccaaacttagatgcaataaaaaatacatactcagtcccatcttcaccactttgcactgtgatttgggaagcccccagtttgggccagaatagatttatcacatggttgttccagaggaacttaactttctgtatttttccaacattgagatccacatcaatatcatgcatgtgacttgcatctggtttgagggatcctttgaaaatctcatattgttttgagtttccattacttccatacaaagcaatcctgatgtacccactcactttcttttttccagacagtgtgactgataccttatatctccaactagtaaagttaccactctctcctgtgttgaggaaaaatatttgttcaacggcactggttttccccttaaattggtcagcatagtgccccattttggggcatccttcagctggacaagggaaacagctattcgcctcgcattcgttgcagagttacatctctttgttctgttctaagccacaggaatgcaaaaacacccaaaacagggccaccaacatcttcctcaggcttctggggtaacctacctcccaaaactcattgtaggaggcacagggatagcccaggaagccatcagggttgaggatgctgcttgagtcagggttttacttcttatagcttggtgctctgttgctagatgcatatatgtgtgtaattgttatgtctttctgatgggttgaccctttcatcatgataaaatgtccctatttttctctagcaacatattttgttttaaagtcaattatgtctgattttatttttatttaaagtgtgactctttatacttaaattataactctgtagttgggtcagatgggtcttgctttttattcattctgacagtctctgcatttaaattgcagtgattaatcaatttacattaaatgtaatggttcttatcgtttaagtgtactaacttgctatttcttttatatttctctttgttcctttgttcttttttcttgcctttttggaattaatcaaaagggtttattattattattattattattattattattattattatttttggcgggggaatggagacagggtctcactctgtcgcccagactggagtacagtggcatgatctccgctcaccgcaacctctgcctcctgggttcaagcgattctcctgcctcagcctcccgagtagctgggatttcaggcacgcaccactaccgcccagctaatttttgtatttttagtagaggcggggtttcaccatgttggccaggctggtcttgaattcctgacctcaaatgatccacccacctctgcctgccaaagtgctgggtttacaagcgtgagccaccgtgcctggcctagtttttcattttatctcatttcaattttggatttttagctatgtgtcttggttgttgtttggggattggagggaggttttttgtagtgattgttctagggattacaattaatttatcacagtatacacattcatggctatggaggtgtggaataatctgacatatttggaaagtgagatgttctttgtgcctggatcttagagattaatgtaggggttaatgtaaccattaatcagactagagtgatgataatattttcatttattaagtacttattatgtgccaggcactgtggtaagtgttttatacatattcaattaaatcatttcatcttcacaactacccagtgggtagatacgagaaaactaaggcttggtaactttccaaaggtcacatagcaagtaagagacaaatccaggatgaaaatcctagcagacataatgaaggtgaaaagaaaatggtatatttgtattggggtgcatttgaaaatttctgaggaaagacaagatgtgagcagacttatattttaacacaactctgcctgctgaattggaaataattagagggcaccaaaacttggactgagataccagtgaagatactgctgttagagtctaggtgagaaataatgagtgcctaaaataggaaaataaaaaagagggtaaaaaagaaaattaaaattcaagagaaaaatcaatatgagctgagatgttagtcataaagagagagagataggaagaaaatagagaatgaaaagtccttattttgtgctaagcttaggaagaaagagtagattcaaatatcggttattactaataccaatatcatcagttgcatatgattttatttgttagactgtatactaatgctattggcattaataacattattgttgttgttgttaatgaaactttcattaccaataactttttaaattattattataatgattaacatttaccaagtgttacctatgtgctaggtactattctaattgctttgtttatatgtattacctcatttaattcccataatagccttgtgagttaggtactaatattccattttgcaattgtggaagctgaggtccaaggaggttaagtaactgcccaaaggcacatagctaataaatagtacagccaaatctagtctgaaagtattgatataattatttggcctgtacaatgcttctttttttaaaaaaatgttaacttgttttcaacatgtagacatcaacataacttaaattttttaaagatacatatttctcagcttcttttaaagcagtatgctagaatctggctatactgggtctgctttcccatatggcagtgttcagctggacttaatgagctgcccctttagacagatcataagctctcaagtagaactcagtgcccatccatcctgcttaccttatttatgttacctgactatcccttttgggatgagttacaaaccttaaggcacaagaatacctgcagttctcaggaattgggggctaagacaaacaaatagaagataataaataagataacctataatttaataatacagtcatggttgagggcacaatattttaaagggacagtgacgaactgggaatttttatagaagatggcttacattgaagagtagatgcaaatagaaccatgaaggtgggcttgatccactttataggtaataatactctaataataataatgctcactatgtctcaggcattgtaacaaatgctttacatgcatatatctctttgaatcctttcaacaaccctatggagtatattattatcctctttttacagatgaggaaaatgaggcccatatcactttggtaatttgtgcaagaatacacagctactttttgattcaatgactctgggcttctgattctggctcagagccctttatagtgtagtttcagaaagtgctgaaaatcttcatagtttccatattctctaagaagaatttgtaaactgagtaagtaacagtgttgcagagaacttacaagtatgatttgcctcaggtgttccatagttgcctctaaatttctttcagggaactgttgaataaaagatgagacagatcagtagtggtgaaaaagatcccaaaagttaatcaataccacaggttgttctggattgaaaaggatgtcactgccttatggaaaagctcctaggttcaatgtgtatccagtttcctgtctattttaaagctcagtaaacaacgcgtaggccaatggagacttcactgttcactctggccagtgcatgacctattcctccagccctgaagaaatccagtttccaaaaagtgattcagttaaacttttttttcttaaatggcaattcagctatttatgaactagtttactgagataatccccttaagctgtagaggacaatttatttaggaaagactgtcaacattcttgattcacaaaagtaaaaaataggcttcttaaatttagtttgtgttaattaaatatactatctccattagcttgtgtttttaaaatagtagattgacagcattacctggttgaatgagtataaagcaaaaactctcctgctgaagaatctcagtaaatgcataaacccaggagcttctatgctgactctttagcatgttggattatttagcagattcttggaattattatcaaatattggcggcagagagatttgtaggacagaccaccaggtccagcctgatcattggcaataatgaagagagaagacacaaacagggtcaggggcagggcaaagagaagacttggggtctccaactgctggagggatattcttctctctgtaccatccagccttgagagctttttaaaaatattaacttattttaaatgtgagattgagacaaatctagtatgtttcacctgtatttgtcataatactactagtatgtctccatcagctgtgaagtatactgcaattaacatattaataataaaatagtaacatttgtggattttttgatataaataaagcagagtcaagattatcccttaaatcagtcagagtctcagcaggaagtggatagtacactaaaaagactaatttagaagagtttaggtaaggtagttcacacctgtaatcccagcactttggcaggcaaaggaaggaagactgtttgaagtccaggagcttgggactagccctggcaacatagcaagccccttctctacaaaaaaaaaaaaaaaaaaaaaaagttttttaattagttgagagtggtggtgtacaactgtagtcccatgtagtcccagctactcaagagactgaggtgggaggatagcttgatcccaggaggttgcggctgcagtgagctatgattgcgccactgcactccagtgtgggcaacagagcgaggtcctgtctcaaaaataaaaataaaggaatttaacgaagtgactattcacaaaagtgtgggcattctccctggacataaaacagggtgaaaaaaggtggagcattgagatcaaacgggcaaacataatacctaacacatcctttaacaatatgttaggccaattgcagtaattttttaaaatccaaaatattgggagtttaatataataaagatccaatgtgggtccatggaggaaataggtgactgtgtcccatgcagtcattcagaaacccaagctctttccatgaactttctgccatggcctaaggcaggagtcagcaaacttttctgtaaagggccaagtagtaaatactttggctttgtgcgtctgcctctgtcacaactacttatctctgttgttgagcacaaaaacagccatagacaatacttaaaggaacaggtataactgtgttccaataaaattttatttacaaaaataggtagcatcaagatttggcccagggggccatagtttgccaatccaggcctaaggcatcataatcttccatggaatcctttacatctgagggcagataagaaaaaagagagtatgtggaagattacatgaatagtttttatggatcatacctggaagtggcatacaagaatcctacccgtatttcattgtccagaactgagtcatgtggctgcatctaacgtcaagtgaagctggcgaatataatctatgtgcccagaaagatgaaaaaactctggcaaacatctggccagcttctatagcttaaaatttcctctaatttccttgctgtaagccaacttttcctaaagggtatctcatatatacaatacatgtactggagactttttagggaaaaaatgggttctgagaccatatatgattagaaataatatttataggttctttcttcatattgagattcacagtgcgtattaacatatcaaaggttctgaaaagtcttatagtgtgaaacaaagaaacaaacaaaaagctccctaaaatgttggtgaacactattttataataaagttactgatgctcacttgcatttggagtgggagatgaagggagtagagtccaggcagtgctggggaaattatttatgatcccatatatttgcattggaatttcttgtgcataaaaactttttaaaatataaagccactacatgaaaacattttttttttaaatttcttcacatccttacctaccacctacacaaatggactgcctactttaatttctgaatattgttcatatgcctatttctgactagaaagttgagttagagctttttttttttttttttttttttttttgagacggagtcttgctctgtcgcccaggctggagtgcagtggcgtgatctcggctcactgcaagctccgcctcccgggttcacaccattctcctgcctcagcctcgctagtagctaggactacaggtgtgcatcaccaggcacaccaccatgcccatctaattttttggtttttttagtagagacggggtttcaccatgttagccaggatggtctcgatctcctgacctcgtgattcgcctgcctcggcctcccaaatgctgggattacaggcgtgagccaccgcgcccggccgagttacagctttttaaattctcctcctccccttaactattattaagaaacacccaagaatgatcaataaatacttaaaaaaaaaaaaaaaagaaattttttttctgtacagagaaagttgaaacatccatttccatgtttgggatgagagaagattatttatgttattggagaacagaagattatagactgtcaataaacttttacttttaaatgaataaataatacatgacaattcttttcacataaaaaaaaaaaagaaagaggaagacctctttgcagttgagataagaggaaggcatctgtctcctgctcatccgtgggcaatggaatgtctcagtgtaaagcccaattgtatattccatctactgagataggggaaaaccgccttagggctggaggtgggacatgctggcagcaatactgctctttaatgcattgagatgtttatgtatatgcacatcaaaatcacagcacttttttctttaccttgtttatgatgcagagacctttgttcacgcgttttcttactgaccttctctccactattaccctattgtcttgccacatccccctctccgggaaacgcccgataatgatcaacaaatactaagggaactcagaggccgcggccggcgcgggtcccccttatgctgaacgctggtcccctgggcccatttttctttctctacactttttctctgtgtctgtttcttttccaagtctctcattccacctaaggagaaacacccacaggtgtggaggggcaacccagcccttcaaatttacatagagttaaatatacacatattactctgaagataaaccttaggtgtaagaaaagtattaagtgagagtgtttgtgtgagtatgagtttgtacatattttcagaaaaaaagagcaataattgcaacaaaacaaataaataagctgactaatagaaaactaaacacctcaaaaatgctgaaagcaaatctatactttttgttttgtcttgaattcctttattcattttattttattttattttattttatttttttgagacagagtttcactcctgttgcccaggctggagtgcaatggcacgatcttggctcactgcaacctccaccttttgggttcaagtgattctcctgcctcagcctcccagtagctgggactacaggcaggtgccaccatgcccagttaaattttttttttttttgtatttttggtggagactgggttttaccatgttggccaggctggtcttgcattcctgatctcaaatgatccatccacctcggcctcccaaagtgatgggattacaggtgtgacctgccacattcagcgtgtcttgaatttattactgtaaaatgttatggcttatggttcagattctccctagaatctgcctattaaagcacaggcatctttgtcttcagaaataacactcttgagtagaacaataaaagccctcttcaaacagaaaaaaataatcatttttaacacttattttaatgaaaatttaaccaacattgagtaattggatatatttttattgttttatgtgtgtgtgaatgtataaaatggtacatacaggaaaaataatttaagccagaaaaaagatgtaagttaatatttgtaatgaatgaaactggagagtagttaattattagttgcagataatatctttgtttatgtagataacaaaaggagcagaaagactattttaaaagtttatttaggtgggtaggcaacattttaagataataccctggattaccagtctgttgcacacctgctgtgtcatactttcctcttcagtgaaaaaaaaatgtgtgactgtgttgggaaatcactcatgaaattaggttactcatctgttgactttgtgtttatcaaaacggagattattctgattgtgctaaacttaatcacaggtgcttctaagagaaagagacacatagaaaaaaaaaaaaaaaaagatttagcctagggtttggagtatggttgaggctgcagctgggaggcaaatggctccagacgtgagaactgcaaatgttagaaatcaggtagagagctgacctacatattaagattccaggagaaaaggtagtttggaatagataaggacacctcttttattcagaatccaaaaagagtattaaaaacaagaggttggtagcattttccaagaatcccagcatcatgtttccaaactctcattgattctgattatagaagggttttccccaggtaactcagaaaaaaatattttaggataatactctttctttcatcttaagtcaaataagtaaaaattcctgagaccagcaatttgcatgaggtaggttgattgttatacagacccacacaggccagtgtctttcattatatactacatttggaaaaaataaccttaattcctgagataagcaccatcaaaatgattgaaaaatctacagtccaaatcattcatttcttaatcccaagagatgctcttccccttcaacctagctgagtgaagaaggcacttccctggagatggcaattagattagaaagcctggagccttccccttgattacttaaaatgatcctaagtccttgagctagcttagatggatgttaatggtttccaggggacagacaacttagaaaagacaacttcattgcacttctcttttccgtttacttacttaacgccttgaaaatacttttctaaattttattaaagagactgcaagcccttaaaaatgaatcagagcgctctctcctgatttcaaatagctgaatgaaattctgccaagtgccgataacaacaatccttctgtgtcatggatggtcaaccctgactcccacacccttaaagcaagtgtgaagtctaatcagtataatgacaaagtagttattaacattttgaaaaaccaccctaaattgctgtacttctatgagttatattggtagattctaactctttttctttggccagattgcttgtctagggactttgtgattaaaaaggcaggagattatttacgaaatgaacaaatgaggtggttgtttactttaccaaagaatttactcactcctgagaaccttctctgtgcattgaaaataggacgtgattgacagccccttttaaattacctttgaatactaaaatgtcagccaaacctgtattttaggttcaattctgttagtggtttatgagcattaaaaaatgtgttaaatatttcttccgtggttattatattccttggacagctttaggcccccacatgtctcttagcctgccttagtttccccattgttcaagtgggataataatactttttttaccccaaagaggtgatttgaaaattaagtggtgaatgagctgctttgaagatgaactgccatgttttcctggttcctttgcttctagattggctcattttgctacggcaaaaatgttgtaaatatgccatgctcagttttcacgttagcatacactcttgaaaacaaaatttgcttaaaatattttcccacttctctgcctttggtttgtggggctttgggttaattagcatcctccagctcttatctaagcctttgctaagggctaattaaccagtgtatactttgtcaaattctaatgagaactgataaggagtctttttagcctgttttattttcttttgggggaggatatattcttttagcaaacatttgtgttttttgcaaggagacaatgtttgttaatttaaccaatgtttactaagcatctttaaggccttttgggggacacaaatgaatataaaaggaaaacaattttaaaggagcaaaggatctgaggaagttaagctagttatagaaatctgtaagccacaaacattatgcatatgtgtgaagagactctagagtaaatgagcactgaagtgggcttaaggtgacaggcttgactgatgtagaggccctgctttggatagtaatgaacaagatgaagtgtgtaggatggactgggggctggggagatataacaggcttaatcaaggaaggagagagacataatcagggatgggggtggagtaacagggacagggagactggagggaaaatagtattgcactgggattcaggagacctgggtttagtcctgatgcaaacttcaccattctgtagctctttgacctttggcttgtcagttcccctcttcaaactttaggtcacgccctccacaattcagggtcagcactatgcaaaagatttccaaggaaggcattctgggatttgaaaacttcctcaagagaagtgagctttaaattttaaattcagtcaagctctcaagttttcagtagacctcacggctgaaaagaaagagattacagaagagagggatggaccttatgaaggcccctttatttgtcttttttccctttgtgtgaagaatcgggtcttgctatgttgcccaagctggtcttgaactactgggctcaagcgatcctcctgcctatgcctccctaagagctgagattacaggcatgagccaccgtgcctggctgaaggcccatttattaaggcccagaaccagcataaggaaaagccatatgaagaaaaaaatatatgagacagaaaattttgtatcaaatgcattagatagatatgtggaaaagagttatcatgtagtagaaaaaaacacaagctttggggttgaatagacctgtctaaggtatgaatccacttacccacttagttgtgattgtgatttcaagcaagttccttaacctctctgaacaagaattttctaattattaaagtggaataataatactacatactaaatagggttgatttgaagacaaaatgaattaatctgagcaaagcacatgtggcttaccatagcactcaataaatggtagtcattcatagcttccaattactgtagccctcgtttgcctggactgttttgctagacaaattagcctacacaaaggggactctttagctcctccttagagactgagcttttatcatcttgaaatcgaggtcttccatgtcagtttacacaacagcaaccccctccctctgacactcttagacttcctcaacatccctcccagaaaactggttttgaggcatctctgctattttcaatttgtcagtatctgaatctgcctggtcccaatcagtctagatgtggagagttggactgcattcttattttccaagtgcctttgattttattcttgtgaatgtagagttttcacagagcactgaggaaggcaaacagcccaatcacccttttcttcattcacaggggcttattgggggcctctgctagggtaaagatttcagttctgttactcagatatgttaggcaaagatctgtttggtgattagttttgattagataggagtttcacacaaaagggggcttgtgcatttattgtagttactgagattaagggagctaggtactgctgtgggaagctgccccattgaaaagaggggccattctttgatgttgagaggcccggccttccccagtgagaaaaatgactgttagtctccctgattttgcaaagcacttgaaaagcgctttaaccaactccttagctttcataatgcttgtttacaggtaggggtttaagtctgtgcaggggaagcaaaatggagatttcatttttcttgtttcccatgatctcagcggcagctcaacttttttcttcctgcttttattctttctcttttttccatcttttacacttaatcacacactcttctttcccaggtcctattcaggtcttttttttttttttttttttccttcatattggacctctgtcatgctacattgatccaacccatacctctccagagcactcacacactttatttatgtatttgtttgtttgtttgtttattgagaaagggtcttgctctgtcacccaagctggagtgcagtggcacaatcatgggtcactgccacctcgacctcctgggcccaagcaatcctcccacctcagccttccaagtagctggaactacaggcatgcacaaccacactggctaatatttaaaagagttttttttttttttttttttttatagagacagagtatttccatgttacccaggctgatctcaaactcctggtctcactcaagtgaaaattaaagtatatacagttgtgtttagaatttttttaatgttttaataagctacaatacatatataagttctaatatatatgtgcaaatgtttgctggtggaatatgcaagaaactggttatcaaaggtttcttctgggctgtcagctagtgggagacttttaatttttgttttgtacttttttgtacagtttgaattttcttaccatgttcatatattgcttttttaaaggccaaagggggtttctggaagatgaattatcattcttttttttctttttgatgcttttctatattaaaaaaaacacaatagatgttattttaaaaaggaaatcaataagacagaccctgtctcagtagagttcgtagtgaatgtgataaaccagagaacagatgctttactagatccaagaatagaggtttgaacaaagttctgaggaaagcatggaggagaaactggttccatttctccaaaggtatcaggaaaatgtcacagaagaggtgacatttgagctaagtcttggtagagcacaggacattggtgggcaacattccaggaagaatggatggaccatacaaaggcacagtggtgtggaaggccatcgtttattcaaagagtgtttattgaggttgaagacacattaatatgtgtctgcaggtgattatgtaagggagattggtaagtaataacaacacatactatgtgctggacgctgggctaggagctttaatttctccacctctaatccttagaagggtgttcaggaatctctggccttaagaacagcagcagtagtagagacagcagcagcccagagtttggatgtggaccaaatcgggttgcaattatagcaatttggtctatctaatccttccttaaagcactgtgttgaggttttagagaagctatatataatgtccttgatgtatagtcagacctcaaaaaagttagctgttatctcatcattaccattccttttctccaaactccagcttagtgctgcatatacagtagcaaatccctacgactgaatgattgatgagagagttgattaaggtatatggtaggacatgatatgacagggatctcacctcctatttctccatccggtccttagtaccaagaagtcagaacattttgcctaagagaacctagtacataccatctctgaatttgtgaggaggcagagctccaggtacttgaagaaaataaagggagttgtatattctctctgtgaagatgatcacccccaaggtttttagactacatggatgacagaataaaaagtaaaaatgaaaaaccatcaacacaaaccaaatttaagataatgtctcttagcttcaataaacaaggcaggataatgctaacaccaacactgaagcaggaagaccctgaaacatggctgctttgtagtgtcatgaaaattaaaatgggagttggaagttcccactttcatcttttagctgtgtgatcttcaacaatgttatttcccccttctggggaaatggtccctctttgttatgggagttaagattggattagagttagagtcagcaaactgcagccaaatccagtcggccacctgtttttataaataaagttttattggaacacagccactctattcatttaactaatatctgtggttgctttccccctgcaacagcagagttgagaagttgtgacaaagactatattgcctgcaaagacaaaaacatttactgtttggccctttacagaaatagtttgctaacctctgattgatgtgtaaggtcccttcctcctctgacaatctgtgatatgcgtactgctaaagacttaatgtgtcagaccatttgcaatccttaggttcacctggaaacctttcatgaaatttggaaatactccagaggtcccacctgtatgtttattattttgtttttgtttattattaatccaaaaacgttttaaggatttgctgtttgctaggtacagtgatagttctgggttgcaatggggagcaaaccagacatgatcctagcagtcatggagcttagagtcttctggaggagacagtttttaacagaacctcctcatatctttcactttggaaagcaaagccaacaaattatttcatggtaggttgaactgtccaggtttacatttgggtttatgaacacctttattcattcatttattagtttattctttcattcattcaatatatacagtcatgcactacataatgacattttggtcaacagtgaaccacatgtacgatggtagtcctataagattataatggagctgaaaatttcctgttgcctagtgacattatacccattgtaacatcatagcagaacacattctttatgtgttggtcatgatgttggtgtaaacaaagctattgcactgccagttgtataaaagtataacacatataattatgtacagccatgatacttggtaataattataaactactattactggttttcgtatttactatactattatcattattgtaaagtgtactccatctacttctgaaacaaaaaagtttactgtaaaacagcctctgacaggtccttcagaaagtgttctaggagaaggcattgttatcataggaggtgatagctccatgtgtgttattgcccccaaacacccactaggatgagatgtggaggtggaagaaagtgatgttgatgatcctgaccctgtgtaagcctaggctaatgtgtgtgtttgtgcctgtgtttttaacagaaaattttaaaaattaacaaaataaaatattttagcaataaaaaaacttatagaataatataaagaaaaacatatttttgtacagctgtacagtgtgtgttttaagctaagtgttactataaaatattcaaaagtctaaaatattagaattatataaagtaaaatagagtaagataaagttaacttattattgaagaaagaaaattattttatacagttagagtagcctaagtgtacagttatagccattgtaacatcatagcagtggtgtagtgtttatgaagcctacagtagtgtactgtaataccctaggccctcacattcactcaccactcacttacccactcacccagaacaacttctagtcctgcaagctccattcatggtaagtgccctagacagggatataattttttaaatcttttataccatatttttacagtgccttttctaggttttgatatgtttggataacaaatacttacattgttttataattgcctgcagaattcacttactgctatatgggtttgtagcctaggagtaataggctatatcatatagcctaggtatatagatagtaagctataccatttaggtttgtataaacctaaatgaaattgcctaacaacacatttctcagaaggcaccatggtggttaagagacatatgactatatatataaagtacttatgtgctaggtgctgggctgggctagatggaaaaatatactaatgaaaaaaaaaaacaaagtttctgttctcatggaccttagatacatattaaattttaaaatgacaaataagtatataattatcaactgttataaatgctctgaagaaaaggagcatggtcacatggcaacaaataacaagggaataagatctagactgatgacatcagggagaagcattccagctaatatccgaaggatgtgtaggaccagtaaatcgagatagtagtactgataattgtttcctttcttggttgatgaaaatggagcttggaaacatgtaaattagtattttttcaatctgaaggttgaaacccattttgaaaaaatcaattatatggatcctgaccaacatttgtttcctatgcaatagaatggaatggacaagattgaaatagaatagaatgaaaatttccagttgttttctggaaataattgttttgtaaaactatgtaaaatgcatttcctctcatcgtgggcctcagtccagaaagatcactgacccaaaagatctgctttggctctatataattacaatttgtcacatagataacagcttctccaggttcctgtctttaagacacgagggtatgttctgcaggtacttccaagcttacctttgtgctcttttcagagtaagtgtaagagtgagtgagagaacaccagccaccatttactgagcacctactctgggaccagacagtgcacaaagtaccttttgtacattataccatttaatcctcacagtaatcctatgaaataggcacaattcatcatctcattatcagataatgatatttgaggttcagagaagttaaggcactagcccaaggccacacagccagtatatttttttgcctacataattagtaatgaaataaacacaaactcaatttgatattctctgaactttcatcagatttgatagaaattaatcaggtttgaaacactggttgagaacctgctagatttctaacacttgtttcatgatctgagttccgtagagcttcaaattaagtctatccctcttctcctttctagaaaaagtattttctaattcctgagctgctttgatggaattttaacccacttaattccaatgtggccaaacacattgtttgcaactgaaaagaaagaatgacactgatgtcatacactattagtcccatagccctgcagatctccaaaaaagaatctgtaaagaagggaatttggggaacaatagactcctatagggtcacaataggcaatatcagagtgatcagctctccaggctgggagatataaataaaaggtgcatggcaagtgaaactacaatagcaaggcctcagggagcagagtttgatgctatcatttagagattggaactggttccatttaattttcctaaatgaaatatattagcaggtgccaccccacatttttactccagtaatttcattcttctttaacatacagtgagaatggtagggggcagggagaaacccctcaatgactaaatagaaagaaattaatagccttttgggtcagagaattataattctgaaagcagattttccttaaccagataatgagctgcagttaaagagaagattggaataatgtgaagataatttcataagtgccccttttcaggaccctctggtttaaaggggcaatctcaacatgatgtgatgcaaaatcactttgcagtggtagtgataaaaattggttttggtaccgcctctaatccaaatttggataaccttgagaaaagtaaattcacttctgtggagcctcagtttcctcatcgtgtaaaatggggatgaaaacaaaacacctggcccaactcagagggttgttgggaggatcaggtggcaaatacataggaaaaatatgtctcatgaactggacatttctataccaatataaggtatgagaatgatacatcaagttcttgcttaagaatgtacaatataaagtccaaactcctcagaagactttttgatgcagctaataatctgatcccacctaacctctctagaattatcactaattatgcctttattagacccctctgctccatttctgtggttttcttactctcctggagatactctttttcctgcttttgttactttacttatgctcttcttcttgcttaggttgtcctttccatctaactaaagcaacttggaagtgcacctagcttaagaagtgccccctccaagaaggctttctacaccttcatcactactcaaaatatgatcctcacacctgactattagaaatgcagatcttcaggtcttgcccagacttactgaatcagcttctgcattttaacaaattccccaaatgatttcttggcacatagagtttgagaagtgctttccagcccacattcgcttctcccttctctggacttttagggcatttagcagtgtctgtcttgctactgaaaactattgttttcaactttgagattgtaggcacttgggaggcagctatatatttactgattttgtgtttaagaaatttttttacctactttcaataccacagaggtttattatgggtcttctgtgtttaagccactgtgggtacaaaaaaatgagtaagatgtagtgcctaccctaaagggactcaaggtctaagaaatggagaaattgctttcttgcttatttcattgcttccttcctttcatctatccttcaatattttataaacattactcttatttcagacacagcactagttgttgggaatttgaggatagctgagacaaaacctcttattttgggtctagtaaaaatacatatgaccataagcaagtaaatttacatttgttaatgctgtaatagtattgccttgggagtgcagttgagtgattgatttgggaaatgaagaagtagaaaaggttacagaaagaaattagagttgaatttggaagttgagtacgaaccctcaggtagacaggggtctcccatacagagggaagagcatgcgcacatacacactaaatacatactatgttttatgtttagggaatgttgagtcattaggtgtggtgacatcatggaatatgtgtgtgttctggggcaggggaagtctgggtggctagaaataaggctcaaaattaggctgggatattccagcactattcaccatagccaagatatggaatcaacctaagcgtccattagcagatgattagatgaagaaaatgtggtaattaatggaatactattcaaccagaaaaaagtggtatacaatggaatactattcaaccataaaaataatgcaataatgtcttttgtagcaacatgaatggaactggaggccattatcccgagtgaaacaactcaggaagtcaagtaccacacgttctcatttataagtgagagctgaaaaatgtgtacacatgaacctagagtgtggaatgatagacatttgagactcagaaaggtgggaggggagtgggtgatgtaaaactatttaatgggtacaatgcacattgttcgtgtgatgaatacactaaaagcccagacttcaccactctgcaatatatccatgtaacaaaactgcacttgtaccccttaaatttatacaaataaaaattaaaaattaaaaaaaattaagccaaaagtcacattaaacatgtcctatgtaacacttaccacaataaggaacttaggttggtttttttcctttcattagacaatggggagttctcggtgattttcagatctattatctcatagcaggtgctcaataaaactttcttgaatagattgtggaaggagataaaaggttcttctcaaggttgtaggcaaagtgttctttaatttactctgaaatgaagcttgttaagaggctactgtgggccagtcgtggtggctcacacctgtaatcccagcactttgggagccctggatgagcagatcacttgaggacaggagttcaagatcagcctggccaatgtggcgaaaccccatctctacaaataatacaaaaaaaattagggtgtggtggcacacacctgtaatcccagccactcagaaggctgaggtgtgagaatcgtttgaacccagaaggcagaggtttgcaatgagccaagatcgcaccactgcactccagcctgggtgacagagcaagacgccctctcaagaaaaaaaaaggtggggggctactgtgatgagagagggaaatatgcctaactatgcataacttaattaagagacttccctatcagaatggcaaaatcaaagcacaactgcaaagcctcagaacaaattgatctgaataaaatgcaggttattacgtcatccaaacccagacagaatgtctgatataagtgaagaatctttgaaatccccctttacaggtagcaggcctgtgagtttctggaaagtgaaggcagaagtacatgcacatggttttgttataaacttgcagctgtgaagaaaaacaattgtgcttaggggtctggacaaccaacttccaagccatgctcttctacttactagtggtgtaatttggggacaagttatacctgtgtttgggggctgaaaatacgcccctgctactttttatttttataacctgctttcctatttgaggaatcttgtatgaaaccaccagggcaaatgtggtattatattactaaatgcccactagattctttgcaggaatttactgactcaacttttgaggaagctctgaagaggtccacatatagagatttatgagcaattgtagaatgccaattgattcatagaatcatggaatttcaaggctcaaaggaaatgtggaagtagtatcgcttttacctcaccaaacctcctctataatattcctaccagataataatcttgctttgtgtttgccccttccagtacgacacacatcacctccagctacatacagtccactctctcgtgtgctagtgcaattctcctcagccactctgagttttagcagttccatccttgttttgagctactgtaatctcacattgcataaatagaagtaaaaatagcacagtatctagaccaggagacttcattgtcttgaattcttctgcactcaagggtagatcatacctcaaagtttaaggatggctctggggcatgaggtttagcacatatgtaaagcaactgagttgtgtccagaagagagtggcttaggacatgagggcacaggtgaagaaagtggggctgttgagactggagaaaagactcctggacaggttagctgtgtttaaatatttgaagggctgtcatggggaaaagggatttaccgtgttctacattggcacaggactagagctaggatcaataggttgaagctctaggaaataaattttaattcaatataaggaaaagctgtctaatagtctgagttctccaaaggaccaataaataggccaccttgagagggaaggagtacccagtaactgcagttatttcaacataggctgaatgctttttaaaaggacatttttggattgggagcccagccctcatggacccttgggtggatcttgagatgttcccaaggaaccttgatgttccctggaatcacttgaaaagaagtggactaggcgacctttacagcccagtttatccctatgagtacacatcaacatgcctgtgatccagtttatatatcaacatgcccatgatcatgtattaacattttacccatctgttcaagttctaccttcttgtaacctactcctttttttaaaatgttttgttaaacttattgtaagaggaaagatccaagctgtctaatagattgtattccttttggcctggagccaaatgacctgtgaccactccctacaggcaggcaaaatagttattagagtaatatggatggtatgttatttcactttctattctcttgagcacacgtgctctctctgtctctgtctctgtctctctgtctctctctctctttctctctctcacacacacacacacacacacacacaaactagtttgatggaattgagatctagagatgccaaatgacttgtccaagttcatatagctacttaatgttagatctaggaatggaaccagaacaatatacgttacattattaatagtgtgccttgaatttctgatgagattgtaagccctttttctcctctaatatatgctctaaatacttacagagttaattaatttagaagtgtgtgtttgtgataaatctgtagtttcaagatatacaacaacatctgatggtatttatgactccttttatctcaaatcagtgaggtttcactggcctcagaagctgtggtgatcttaatacatgagacttaagatgactatgggcatgcctgttgctcccaggctctctcttgtgaaaagattctgggttgttctttatgtatactgtccacgttttatgacttggaagttccattcagcttcctttaaaatcccttggctaaaatcgaatgttgtcccagggatgacttagtgcactgggcctaggagagagggcttcctctcttggatggctgagtagttcctttaatctatttaccacaagtgttcattgctctgaggctctgggattcttcaggatgaaagccctctataaatatttgttattgttatgataaccagtatggcttcctgagtcagataaatttgtcttctggcttctgcttttcatagcttccctccctatccttttatttctctctccagataacttttgtattggggaagtaatctatttgtgcagttaattaagctgagtgcaatgtgatagacattagtgactgtccaggttgtgactgctaagggatgaaggccttagagctgagggttcataccataaatatatattttcatcaaccagagggaaaaaaatccttgaaaacagaattaaaaatgatagcagaagaataattaaatattgcatggaggggtcatggggactggtttccacaaaattaaaaatggtaaatcgatgtttgcaatatcctgtagactatcatcatgatagctctgacttccagcctcctctaagatgatagtcagactctttacagggaacacagccttccctgatctgccccacgctaatttcccagacttactcttcactctaatgaatcattcccattcctccttgcttataaaatgactccacttcttaaaagaaaacccccggtccttcaaaggttaaagtgttggccgggtgcggtagctcacacctgtaatcccagcactttgggaggccgaggtgggcagatcacgaggtcaggagttcgagaccagcttggccaacatagtgaaaacctgtctctactaaaaatacaaaaaaaaagctgggcatggtggcaggtgcctgtaatcccagctactcgggaggctgaggcaggagaatggcttgagcccgggaggcggaggttgcagtgagccgagattgtgccattgcactccaacctgagtgacaagagcaagacttcatctcaaaaaaaaaaaaaaaaaaaggttaaagtgtcaactctcatgaaactgccctgactatactaatcgcaaaacatcaatctctctactcctttttctgaaatcctgtactcctctctgcattctcatgtggcatgtcatagtttggggaagtaaattctggtaatcttctcaagtgagtcattcttgtctcccaaatattatcagtttgtaagctcctgaaagacagaacccaatgcttctttatataatgtgtccttgtattcccaacagcaccttttgcatagtaaatactggattaattgtttagttgataacttcatgtttgaggagagtcatagttgaacagaatggaaaaggaagactcatagttggatattgacaagaatgaaattatgtggggacctcagccattgagatgaaggaaaactggatagatccctggagtttcggattatttagcagttgggtaagaagattagttggtagtactgcacagaccaaaacatctggttgcctccaaatatgatcaacacagctgttggtgtacttagaattacttctcttccaaggttaatgacttttgtccagctgtgtccagtcttctagcagctactcagaatatagccattctggatcacatctgttgactctacacaagtaagaaatgtacacggaacttctttatttctttaactgcaaatatgttatgtaggcggtattaccctgaaacttatacttcctaaaggcaaattatggcagcccctatactttaactttcctgaacatataagcatttaaaatgaataccatatatttgctcactcacacctgtcccccactgtcttgaattctgcattgatacattgttcccacttcaagccaagaacttgtttgtattgagtcctgaaacacaaagtaggcacctagtaggcacttaataagttttggctgatttaattaaagatctgctaaatagagtctaaacaccaaaccacctgtatttaattttaagaagaaatgaccagagatagacataatcatgaatctcctggtacaggaaagagtattacaggaatagtgtagacagttatccttcattaccttgcaagacaggataataggaaaaatacctgcaattgcagcttgcctgaattagataagaaggcaatattagcagaatgattaaaaacaaggactttggtgtcagacagatctggattagagtcttagctcccgtcactgattagctgtgtggccttcggtaatttacttattctttggccctcaattgtctaatttataaaatgaggataatgatatggcctaccacatgggattggcttgaggataaaataaaatgatgtaggagactttcacattttttacgaggtggagaaggagccagtggagaataaaaggttgatgatacaagaaagggagagaataactgattggcaaggacttggagataatatcttttgaacactatggacagatctgctttcagaatggtttggaattcagctctgtcttgaaccatattcaaactacttatctctagtgcagatccggtccctaggactctgaagctcttttcgatgtactccctctccctcatgcctgctccagaagcaccaccctctagaaaggatcaggactcctagctttccatttcagccaccttattgtacccataccttaccttatgttatgttgccagcttatagacagaattcaaaagaaaagactgctgaagaaagcctttgctttattatgtctgcagtcttctgaagttaaaaaaaattcagttatatcataaccaatagaatgggaagagaaaaatttttaaaagtcattatcagccaggcacggtggctcacgcctataatcccagcactctgggaggctgaggagggcagatcacctgagttcaggagttcgagaccagcctggccaacgtgaagaaaccccatctctaataaaaatacaaaaattagccaggtgcagtggctcacgcctgtggtcccagctactcgggaggctgaggcaggagaattgcttgaacccaggaggcagaagttgtagtgagcccagattgtgccactacactccagcctgggcaacagagtagtgagactctgtctcaaaaaaaaaaaaaaaaagtcattatccttgaacttaggtcttcttagacgttatagctaaagcaaggtagagccatactagtcctcaaaagaattcttactattttcttagttactttacctgtcagtgttcatgcttccattcagtaaaatgcctacagctgtgcctggtattggaaatacagaaatggataatatactgtccatgctgtcaaataatttgtagtctgataggggagacagaagaggaaaattacagttcctatgctgagttctaagtgctgtgcagcaccaggggtgctgtgtgcatctggggcaccctacgttttggggaaggtgtcaggcaagacttcttgggaagcctgagggctaatgatattatacaagaataaccttgaatctgctttcaactcttggcaaactttggtactttagcaattatttgtaacaaattatttggatatagcttacaactgattttaacaggccgatgatgtgttataagggttacaagactataaaatgccttcctatctgggttcccagtcccaagccatccctattctaggacaacatatacgtaactgctagagttactctcccaaaagtcctccaagaagaagtgtcaagttggagttatccaagagaagggggagagggagaagcaaggagaagaagaaaaaggcatactgggcaaagtaatatcgtacacaaaaggcaaggggtgaaagaggggaatgtgtagtgtgtagtgtaaagggagattggtggaagtgacaagagaagttcagagaatcagcatggagggacacgtatgccatggtaaggaagttggattcagttctacaaggtaatgagaaatcacagaagcagtttttttaagagtgaccatctatctatgtgttatcactgtcttacctcagtgtttgtcaggtggggaaactgaggccagggtgtaagcagaattttatcaaattccaggttggagtggtattttagggccaaagctgagatggagtcaaaccatttcatgcctttactgacaagccacctagctctggtctagggactgtgaaatagtaagcagagaaggcttagacttatcagtaacaggtttggggaatcatgcatagtcttgttcccagtgtgtataatgataagactctgccagaagtcttctagctctaacattccttttctctcttgtctcagtcctgtgtattttcaagctctctacccatcattgtaagcattcactgagtgaattatctatatttgtctgtttgtatatatgtatgtatgttgagaaggtaatactagaaaaaccaaactgctaaaaaggaatagagaacagcctagaaagaggtaatataaataaaaagcatttagggttcgaaacatttcttttttctactttaaatgcatggaatagagttttctactctttgttgttgtatcatgaggatgatgaattaatgtctgccggcatttttagcttttttttttcagatgaaatgtgcttcttctgctcttattattctaatagataaatattacagatgaaaaattccaggaaaataaagaatgatgattacatccctgagctgtctgtattgatgacttgttgccagtttcttcatacttatcttaaagccatttaattaaactttttcttggagaactctttcagtaggtgatagaaacttggatttacattgtcatttatgtgaagggctaatattcttacactgtggtatttcctgcctttttttcagacatttctgcctgttatggaaaagtttaagtcttggggctcaggggtaacttgataaatcaaaattccatgtttcaaatctggctcaatatgaagtgagtttttcacccttcaaacctatttacttcctaggagcctagctactggtttagccccatatcttcctaggctgcttcacaatacttttcagcctttgttatgtaaattccaactcttaaacatagattcctatattgtttgaacacctcccctcccatatggttaagacagataaagactttcttttttttattttattttattattattatactttaagttttagggtacatatgcacaatgtgcaggttagttacatatgtatacatgtgccatggtggtgtgctgtacccattaatcatcattctcagtaaactatcgcaaggacaaaaaaccaaacaccgcatgttctcactcataggtgggaatggaacaatgagaacacatggatacaggaaggggagcatcacactctggggactgttgtggggtggggggagggggaagggatagcattaggagatatacctaatgctaaatgacgagttaatgggtgcagataaagactttcaagcaagatcgcctaggtttcaatccttgacctgacatttactagctgtcaatcttaggtgttttttagcttctctttggcttagtttcctcctctgaaaaatggggttattagtagtatctaccttgtcaggttgtaatgagaattaaataacttcactacgtaaagcatctgaaaagtgcttatcacataatcaatattattatctgcctgctaattatctgctgattttgttattccttctattttgtatttgttattccctcaatttataactttctttcctaagagttttgcatggctgactctttatcatcaggcaggtgtccattcaaatgtcatcccctcagggaggcattccctgtccacccaatctaaagtaggtccctccctgccaggctctgtcatatcaccctgtgattgccttaattgttcatgtccaccatctgtaattatctagttttttatttatgtactatttgagtactttcaccagaacataagctccatggggccagggaccttgtctgccttgttcaccactgtaccaaatagcatgtggcaatgttcagttgaaatgcattgaatgaataaacaaatactgtgattccattttctgaaccaaagccagtgcaccttgtctgtcaaagaacctttatttgtgtgcttctaggtgtagaaactactggatggtatattttggattataaaaatggaaacttcttgtacatttttgatagtttaggtggagacagcactgagaatgtcattagaactggcttggaaaacccattcatgtgatctctgtaatgccagtgtttcctacagtggtccttgcaaaatgggtacccgatagtgttagtcactccctcctcttgtcccttgggtctccttggatggatctggacatctcaaggggtatgactttgtaatttttattttgatgtctctagagcacttagtacagtgatttgtacacagtgggtgctcaataattgtccaccctgtgaatgaaccttctctttttctttaacatcacaacttcatatatcaacgaggtgtggaaagaaaagagacaacttacgtagggttgtcaagagttatgacttatatttgagggtttgaatagcaaatacactaaaaacagccaatcacctaataagagattgtctaacccaggccctagatacttctcaaagagaccattgtttggtgacttcaaggtgggttccctgtcagactttcaggttgccatagagatgacatgtttttcttcctaaatgatatttgcttgtaatctcagaactctgttcaggaaattagcacaggttatttgggagtgagaaaggagtgactatggcagcttcgagccttgctacctggtaaaggcctagtttgctaaatgaagtaaaaaaaaaggggggggggagggatttaaactgcattctaaggaaaaggttagagttgtgaagcctttcttttcccctactgtgaatgaggaggtgatatacaaagaaagaagaaagagttccaagtcacagggttcaaaattcagggctatattatgcctgtaatagttgttgccacagaaaatgggacttgtggaaagaaaaagttatcatcagtatcatctaataaagcacttatagaaatgtactgagcaccatggaaacattttgtggtgtctggtagttataatttatcttagtatatgcttgttgagggaagagaccacattttaccattccctttgcatccggtgcagcaccttaacctgtctcatctgcaaggtctctttccttttcctcctcccttgtattaatctttctaaattactcttctcatagcgtcacttattttttttttgagatggagtctaactctgtcacccaggctggagtgcagtggcacaatctcgcaatctcagctcactgcaacctctgccacacgggttcaagccattcttgagcctcagcctcccaaatagctgggattacaggcacatgccaccatgcccagctaatttttgtatttttagtagagacagggtttcaccatgttggccaggctggtcttgaactcctgacctcaagtgatccacctgcctcagcctcccaaagtgctaggattacaggcgtgagccacagcgctcggccagcatcactttctatcaaaacatttaatggtgcctccttgtcagttgaataaaatcaaacccttaagcctaacactaaaaccctttcaagatctatctttctagcttactttcccactacttccataatatacgctaatctcagacatcctggagtacttatcttgcatttcctgtatatgccctgtgctcttttggtttgatctttcccaccacctcctcctccactgaatgtttgcttatgctgttccttccctctggaatgcctctccctcaccctataatctctagctaatgaaattcttcccatcctttaaagctcatttaaatgctacctcagtaggaagtgatcttttggtgttgtgaattcctttagccttttctcctaatcttcttttcatcctcctgaggcttaatacaaagcctcccatacaggtattcaaatatttgaaaaaattataaatgaactgtaggttgagtcacatatatgcctcccagaggcagaaatgacagccatcttgcaaggctagctaagaggtgttctgtatactgaagcttgttttctcattgtattccatgataaaaagagaagatgaatttcaggattgtttgggcagcaataatcagggaaagagaaggaaatttacatgagtacaactaaggattttctgagaagacctggcttgtcactgcttctaggagtagaacccaggccttagggggaaagatatggagacctagaaacactgaggacagtgaacttgtctagcctttttttcttcttataaccactaccctgtatagctcagccacgctggcgttgccttcaccatcacctcatcaaacagtgtcctgtcattctgttgccaaggaaactatatggtgggattccactgatgggggattaatacaaggaaagaaaacaaatatacattccctcaattaagacatccccacaaggaagcccaaagttctgtcaagcctcataagatgacaggcaaaattgcctgctaccttgtccagaagcagcatggcatacatagctcaatgctaatgacagagggctgtaagcacgtaatcccttaggaccatggcatgatggtccaaagcacctaccataagtgtaattctcatgccttatcttaaaaattcagacctattttgcagtcttctctaaaatgtaattgtgtttgttgggatatttaaaataatgttttaagatgaagttgatgttccatagatgtgtataggtttatgctgtagctttaaaggactacctgggacacctctgtatattccagtattagtctcagccctgatgtggtgaggattaaatgagataatatttagcatgcaacccagtgctagaaacatagtaagtgctccatatgggacttgtttgtggttaatttctctcagaatacagtttctttgtccattaaatgagattacagtgataccttcatcaaagatttgtcactaggattctgtgaaatatgcatgcaaagtacattgactccttgttgcctggcaatgtaaaagcccacttttgaggggaggactttgctattcacattccacagagtaaaatgttgggttgtattcacattcaacacagctttagtgttcatttcttatgcatcaggcatgttcttctctttttatgtggagatagaggaaataaaatggaagcaacagcaggtaagcaacacttgggtgcacacgcacttcacaacagccgcagaaatacttctccaaatgcctgcattcacctgactccaaagaaaaggccgcaggcagagtattctgaccaagattcctgtgtcccaaagaccttgccacattgatcggggaaaaagaagttttgtattaagatggcaattacccagacaatttgcaaagggtattttacctgccagtatgttccctggcagaaatgatctctgattacaagcctcatgcagtgaatatatagatatcttgtttcactatcttgcctctgtgtggggtgtgtgtgtatgcgtggatgttgaagtgtgtgtttaatttatgtttcttgctgcttgaagagatacagcttcgatgttttttcttttcacataaaatcactatttatccccagctgaaaataacctttttattgttcttgtttttgtctccttctttctgtgcctctacaagcaaagcttcctgttgaatcttgaaacatctgactttaaaatcagggtacagtcttgtgagggtatttccacgtgcaatcagtcacagaagccatgcagccaagtgccttagtagattgcaatcacagggttgtattcactcgaggtgtggctgtgagggtctccccagctacccttctaacatacacatagatatacacaggcatacacacatacacacacacacacacacacacacacacacacacagagagagagagttacctccttttttaatactgtttatttgtatgtttaaagactgaattttataaattaaaaattaaattatacacattgctacaatgatttattttcaaatcagaaaatgcagacaagtataaagaagaaacaaataccattccaccccccaaccccaagaaaatagccactgttagcatttgtagaagtgacttacatttttctaggacacaaattcatttaatttcaccttagtaatgaaaagaaaactgtcaatagggcacaattctttggacgatgacagtaatgtgacttgaaatgaagcaaagtccaggcgctaggatgtgcacctgagagatgattgggaccccgaggctaagcttggctgcagcggaattcattgtggggagaacagagaattaaatgccagaacagaagctattacagagggattgactgtccttgcccaggctctatagcgtaagcaaaactttccctactccttgctggctgaaaccctgagttctgactcttgagaaggaaagggttcgattttgacggtcaactacacataatcaccttcccgcattgtcccgaaaccagaaacggagtcagtactaagtaccaaggtcctttgaacatcatttatttttcaggaaccactctttcaaaaaaaaaatcaattacagatgctttttgggagagtgggatgtgtggcaaagagacatgaaagtcagcgttccgcaagatttagttgttacttatgggaagatgaatgatttaaatctctcttgaagctgaacctccttaagtatccacttatattgtcactacccatgagcatgtcagggcaatatatgtatatatagatttacctagatgcctgaattggttttttcattctttccaccaattcctacaactctggttctcaaactgtagccttagaagcacctgtagagcttggagatggaagggggtgctacttccagagtttctgactttagtaggtctgggatgaggacctgagaatctgtatttcctacaagtttctaggtgatgatgataatgctggtttgagaaccagattttgagaatcactgccctacaagaatatataggcatgatttcatctcaaaatatttagggaaaagatgaaactgtgaattttccaaaatattattcctgatttaggctaattttggtagaaaattattgaatttagccaccactactccattaccccatatatattgcagattgtatttttcaatttatgatagcatttttgttttagagttcctttttatctatccttctgccctccgatcaacagaatttctcccatctttgtctttctgaaaaagtataatttcctaatacctcagtggtatgtgggcagtcttttttggagaagatttctagctctgccaattattagctgtagatccttcagtaagttagctgacatttctgaaccccagtgtccacatctgtaaaaaggacaaaaccaaaacaaacagaaaaacatgtggctcacctagggagtgtgtgcatcagacaagataaatagtgtataaaatgcctagcatagacgaaaataaatgttaggcccccatatcccttctattatctgtatttatgttgcagggattgttactactatttctagtgttgattcatctataatagaatatagtatctatctaatggagccaaggcaacatctcctggagatctcagcaaatcaagatttccctatggttctaagacatattttatgtcagggacaagtgggaacaggaataattacagcaagcatttattggtgcctgctactatgattgttgagaatgatctcatctaatcctaacgacagccccatacggaaagtattattataatcattattttacagatgaggaaatggaggctcagaaaagttaggtaacttgcctgaggtcccacagatgctaataaatgcagagccaagatctaaaccaagggctatcttttctccaaagtctgagccccctaattattgcacaacactgcctctccagttcagtatcataagctgtccctgttgagaagggaccttagacatcacagagtaatcctttcatagtagagatgaaagaactgaggcctggtggtggagtgagatacatcagctcactgatggcaaagccaagagctaaacttgggttgactctaacctctgaactttttacagcaatatagttttgctttcgtacaaatgaaaagttttcactgtgccgttcaagcatcagacaaacaaacaatgactctactgaattagagggaaaatttaacaatcagctctctgtgggaggaagggaaagccctgatttgtagcttttgccaatttccatggtataaatactcccaccaaggctgatttcaacttatccatgtcatggcactggatgctaagttgggaggagatgcacacaatccactgcctcaagctggtgtgatctgactctagcataccactgcatccgtcctcatggagaatgacaaccaaaccctgagtattgttccaagctaagattctgatggtgaagaaaaaaatgagtgtttcttatatgccaggattctgaaattcaatagaattggtatcctcgccaactcttcttttagagtttaggactggttctattactgggattgagcctttgccaaggccctcttgtgacttatttatagaacttttcccccccaaaggatatatgaatatattgtgtcatgctctatctttagaaatgctaatcccttgtctcaattgatatctttgaaattgaggataaattaaagtacaccaaagaagttgtttgtttttattttgttttaatttaaactaccaaaaaaatagttttaaaacttataaaatgacccaaagaacacatatttattttaggaaatttagaaaactcatgcaaacaaaagaaaataggttttaaaaaaatccgtttttccaaaatccagaggtaaacatggctaacatattggtgtacatatttctaatgttttttccttcctatatgcagatagaatttttttccaaaaaaaaatagccctacaataaaggaaatccatttgcaaaatgaaaagctatcacagattattatcttccatgtacaggtcctgccattctattcatattcacggaaatgatatgttagctatatttatgctgatgttcttcacgcatttgaagataatactgctaatggggattgttatctgtgagtacagatgggactaaaaagaccagggtgacagtctcagccttttccactccatagaccactgtacacacaaagactgttttcgagttacaattgcagctgtgcggatatggtgactgattgggactctgcctctgagacccgaggtcatcctagagctcagaaaacaaccccctcctgcactcccttattgctgtagccagcctggcctgcctgctgcttgtttcctgctgcctgcagctcagccccattgtttgaagtggggcttcagagctgctttaatgggttttcttctgccctccctgcttggggttgcctcacttcagttcaccatacaacagtctgatctggtgtcctggggccatccatccttcacacatgtccagcccagtggggcgctgttagaaatggaatttgttcattccctctcctcagtcttgatttttgtgaaacaataccctagaaaaatttaccagtcataataacaatgctagatgactgactctgggaaattaatgtttctttctgaagtagatgctcattaataagttggggaatagtggccaacaagacttaccagaaggtaaggtaaagtaactgacctctctggaatctttgcttttggctgtgagtctcaaatgtggatttgacagatccttttctgacatgttcctgagttcaattccctccttgaaggccaacgttgaaagacagataatcagcaaatgtttgggaaatgcagctcttaattaggagttgcttaaacgtgtggtaaattgtatatacagcaggtcctattcaatgccattttattaaaatgttaatgaggaaaaaaattgattctccccagggccactgcccatgtggaaggtgcacatcctcctcatgtctgcgtgtgttctttgggtactccgctttcctcccacttcccacacttgtgcacatgaggtgtctaagttgtcctagtgtaagtgggtggtgtgtgagtgctccctgcgacgggatggcatcctgtccagggtggttctcaccttgcatgccccctgtgctgccaggatgggcttcggccacccacaaccctgagctggaattagcgggttggaaaataactaaatgaagtaatacaaattattggaaaataaaaatttgtaaagtatatgataaccatacaaatgcatgacaataaacgacactctaggaaagcactcaacaatctgccacatttgtgattcttctggaactgctgggtggcaggaggtgctccttatgatttcgctttgcaaacatttatatcttgacctgacccaccatcactacgaccgctgtcactcaccaattcaccaaaaattgggcaaataattctctttcttgttcttattaacttttcttaaatgtatgtatagctcacacttatttaaatgtttaatattagaagtgttttgggtctttatttagaagtttggtggctttgaccagatgtatgctgtaggaacttaacttttgttactcttgtttgtatcaattagcctagagtaaaattggcttcattatacatcatttcacttacagtcacactttccaagaacctattgatgttaagtgaggacttaattacatatcattgtataaatgggtgatatttggtgggttcatgctgatatttttcgtgtagcacattatttattggtagactgtcaggctctctccaaagagaagaaacctttttggtgggaaaacaatgtaacaaaagagagcccaggcctctggacagtttgtgaaaggcggtattttttttttcatttcagaggagttaagagtactagttgagtgaccttaagaaaataatttcacctgtcctgtctcagtttccttcttagtaaaagggaaatactaatatattctctatggtgatgttgtaaagattaaatgaaaaagagtagcacttgaagcgcttcacacacactgcctggcacataataaattctatgttcattaaatgatggctatattctccaaggggaaggcagtatccacatggctccaggtggcaaggtagtgttccccatgcaggggaaccagttgaccctccagttaaatgttggtgccacggtgtgtggggggtgcgggggtgtttctggtttcccctcttgtgttgcttcaaatcctggtgaatcacaacatttagacttgtgtttctcaaccttggctgcacattgcaattatgtggggagctttaaaaagtatggatgcctgagtcccaccttcagagagtctgatttaatttatctgcagtggtacctgggcaaagggatttttcaaagctcccccaagtgattctaatgtgcagtcagagttgagaatcacttgattttaggcagatgctccacatctgtgacaaagatgatgaaaattaacatcatgctataggaggcagcgtgccactacagccttgatcatggattccttccaaatctcttgacccagggcaataatcaccaacccacaaaatttgcattagccccacctgtatttatcaaatgtcaccatcagccatactgtaccacactccattaaatgcgcgtaatttgcataaggggcagggataaaaagctcacacctggttttgtaatcaggttaagaaaatgtacagtagtctaagagttaatctcattaatgctgatctcctatgcttgggttgttagctattactcagcttttattaatttaggcttgaacatgtatctgccttgtccacaattccagatgatgctataactcatgcccttctgtcagttccagaagatgactacatgtgttttatttagataaactgaaattatttcagctttcaactgttttggtaattttgtttcatttatggatgatgagtggtaagatccactcttcatttttacatactaaaagtcatctgaaaacagatttgtttggttaatgaagtcttatgggatgggaaagattgaggagggaacatagtacttgaagttttagttagtatggattaaaaacaagtagggcaacttttgtttgcttggagggctcaaaaccaggtaaataaaaccctacgttgagattcagtagttaggaacaggtattcactctatatgtctatgatgtgtactagcttaatttaggtttagtttagcttagtttagacacttaatccatgctggagacactattagtaacataggaacattcatcccccacccatggttagtatccatctgggtaacaggccagatgaagttaatttctatataaaatggaaatataagtcatatccactcaaatatttgaatttatatctggattctttcctgtaaatgtcttgctgctcttgatggaggaaaatggatatggtttttacataaggacatgatttatgaagcaactctctgaaccccaaaaagcctagtggcaaataaatttgtcaatttgaaatcaaaggatcttgaatcagaaacaaatgattgttgatcatagaatattgttttaatttaaagcattttttctcataatcactcattggaaatgaattgttgatactatggcttttaatatgtgacttaaattgctcaaaaaaaatgaaaagtatctttttgaaacatcaggaaaaaaaagccttctggacaggccttagtgctgagtctcagcaaaattcaagttttatcttaagcacatatcttttatgttccaaaatctttctgaaaactctgagattctgccaagttggatgaagaaagcagaaagggagcatagttggtttttgttttgtttgtaaagctgttccctctttcttgtttattcttggtggccaagagacagatcctgggttgctttgttctttggctgggatcactaccttaccatatgaagggatttttaaagcttcggtttgcttccttgaagtaaaaggcagatgcaacttttgcctttaagtacattctcagtggaaactaatgtttggggtgtttcgaggggctgattttagacatggagtcctgtcctggaactttcaatgcagatctgagcctgtgagaaacattactttttgaaatggagttgattttattcttgggattgacaaaatagaaacaatacttactaactacaaccagtaaagtggatctttacaaacagaacattcatggaaaaaaaaacatgcaattttattttatccctaccacttgataatagttaagattgtctaatcaatttcactattgttgcacttccaggatgcttgattgggtcacctttcgttaatggctagtagtgctaactggcatgcaacttaactccccccaacgctcacccctcctttcttcactgccttttttttttttttttttggctttttgcctttgcagccaaaaatagctggcaaattatgttcattttcaacctaatttggaatggaagggaaaaaccaaaattttattgcaatattttttattgcttcagttactctgaacatttattatttactattatcctttatctggataatgactgctttgtttgccatttcaaccaatagttaattcatcagcaaaatcaaatctcaaacttcacatctcttccaatccacaaatcctgttcatctctaattccaaacttacatgcctctatgactagggatatttattcttgtttagtaatgtttattttgttatgcttttccttgaaagaaggactattttataagcagtaacttttcttctgtaattaaacattccatccaaccaaaaatagaccttgagaatctcaatcatttttttactgccctatatcattgtctatacatctcggatcttgccacagttccgtccccctgatttagatggcatgaagacagaagccacatttagtggcttacacatagcaggtgtttgttaaattgaattgagtcacttatgggcaccatgtcaactcccagcctttgtacatacacacacacacacacacacacacacacacacacacacactatatatatatatatatatatatatatatattcccattaatctttttcatagcgctcttttcctttcctttgtagtatttattataaattctaaatttatagattgataaaaactgaacttcatatctacacacattaaaaaaagtactgcttagtacctttctatatgcttgtcacttggaacaactctatgagtcatgtaagttccatgaggccaagactcatgtcccacttgttttccactgtatccccagtagataatgcagtgtctaacacataccaggcactctcaaatactgtttgaataaatgaagaaaaattttttacttacccttaaactagctctatataactgtctaattccaccattagagggcatgtagggtcaaagtttcattcaataaatatccactgggtagctacctagacaagcactgtgatcggctctattgcaggcccaaagaatttagcaaaagatgcctgcaattgaaagccttgtttctaaatagggatgcaagacataccttgtgcagcaagatgtctacccataattattcgtagaatgtgccattgcttttctcattcattgtacagagtgtatttttggttcaaaaggggtgttagcttaggagtgttctcagaggaaggttacctggccctttgggtgtcaccttacttagttccccatatttctgggtctggccctaagctttgcccacttgggaatttaattttgtcagcccaggggtagtagggatatatcatttattagcctacactagccaaggtcacaagaggtggacacctagactagaatacaatttattgaattagcataagaaaagataattgctaagcatctgatggtcacatgaacaagtcttctgcctgtaggaaaatccatgtgggaagccaaaagataacagaaaggttgctttatgtgtgtagcaccattgcaaggggagttggttgcataatcttaatattttgtggcagccaactctaatggtctgatccatccgtcttcaggatggggatttgctaacctcagttaatggaaaatagatttcttgagccagaggttcttcctagccttgggagtgctgctttgccaagaacttccttctgaaaatccacattttcaatatttccaactaaccttcttcctctcaatggactctctctttccttagatatgataataacattgtttgggttactgtctggactggctttcagcctggaacctctgctgtatcttttaaggtgactttgcacctttagtcttatctaatgtgttttaattttattcatcaaattctcagagtttagtgggtgcatttatcggtcctctgggaatctttatataatctagtacaattctcaaatgaaagagggaaatgcatttctgacccaagagtcactgccattttttcagatggaagaaaaatttttcagcggtagaagtgattagttttgccttggggagtgtattagtctgttttcacggtgctgataaaggcatacccaagactgagtaatttataaagaaaaagaggtttaatggactcatagttccatggggctggggaaccctcacaatcatgatggaaggcaaaaggcacatctttcatggtggcaggcaagagagaatgagagccaaaagaaagggaaaaccccttataaaaccatcatgtctgctgagacttattcactaccaccagaacagtatgggggaaactgctccctgtgattcaattatctcccactgggtccttcccacaacaggtgggaattataggagctacaattcaagatgagatttggatggggacacagccaaaccatacagggagttaggaaaggctttccagaagaggtgacattagagctgaatcacaaattagaagctgtagatgtggaatggagaatatggtagtttccaagtggcgagaacaacttgtacacatgttattgtgtacttgtaaggcattgttgcatattaggatgaataagacacagcccaatggatgtttaggtaggttcaatgacagaaagctcagatacatcccctgttgcatgactctcattcagccttacaaaccctaggatacagcagctattgcccattctgtctgaaacactgcatccaagccaagtcttgatccttaaattattaaaatcttttctaaatacacaaacacaaatatgagagtgcttcctccataagcttctaaagcattttttcctttcatggcctttataaagtatagttatttgtgtaaatatataaatttgacctgccctcctgtccattccccccccccaccccactagtagattataagttcctggaagaaaaataactttattttttaatgaactattttagatatttgtcattcctatgtatgtctttatatttttactgcatttttcagaaacataaaagtgttttacatgtttttaaaccttatttaaatgatatgaaacatcattctacagcttgctgttttcattcattttacttacatcttaataatcaactatattatatttctatttatttcattttaacctttatttattacttcattatatgcctataatcataatttggtgatcttttcatttcttcctgaatatttaagttatgtttacatttttggggtaacagagacaaccattttggaaaacatttgccaatatatagtaaagttgaaaatgcacatgcttgtcaactaagtaagtcaatttctagatatatacactgggtctgtactatccaacatggtagccattaaccacatgtgaccatttaaattaaaactttaattaattaaaatttaaaaataaaatagtatttaaatttcagctcctcagtagaactagccatatttcaggtgtccaatagccatagatggctagtggctactgaattgaagcacacagatatagagcatttccatcatcacagacattctaatgaactctccaatgctgccctggagaataattttatttgtattttcccagtacactatgaacataaaaagcactaaatagctatggagtgaatgaatgaatgtgaaaatactgcattacagagctatatatggtaaatgttaactgagttccaggaagaagagctatatgaggttagagggggtgattgcgtataagggtcctgggcatgggcttggaggaggatcgactaaggtgtttatccagggcaatcaactgcagcatagcaagaggaagagttggaaatcattactgcagagaaaataagataactaaagaacagaaaagccgtagcaagaatcagatccaaagcaagactgtgagaggggaaaacgagttatgaggtcagaagccaaaaagattaaacggaggctaagaggtggagtgcaaggcaggtcagagagagcagttcaggacagatgctgtgaataatgtaaagtatctgaagtctgtgctctgggctttgagggctgagtaaactctcaatcctgtgatcaaaatatgttcatttcctaagtatattgccatcatccacaagacctatctactactttgaaagctatgtttaagagagggttatctgtaaacatgtggaagaataggatttgactcccacaacatatagctatcaaagtttgggagggtgagggtgaggcctgaactgggctgctaagaactgaatttctgaggttaattactctaggaagaggaagagaacatggagggagcaaatgtggtatagaagagtagatcaaaaaggaaaggaggatgaaaagggcgaaggtcagccaaaaatcgaatacaatgagaggggacgttgtgcaggtcttaatattggttttcagttaattgtagagttatttctataaacttaaaagccagcaggaatgtgatgtgggattcagaagctgttggtctaatttagtcaaaaactacagagagctctagccccaggctcttgcctggctttctgagctgctttgtagcccactcctggttttcacaaaagtttcttcagctctttcctgccccaccaaccccactaactttcagagtcagaggtactgattaaaagatctgattcccaacattttttttggcagggagagagagcaggtgtgtggccacaggggaagttgggtatgagtgaaaaatcagagacagccattttaaagtgcctgagtcaagcaggctatcctatgtctctctcatatcttgtaaaattcagcttgacggtaaaaatctcatctctcctgcccactcccttcacaattttacatactatagtctaaactaatttaagctttcagctgttattttcaaaacttgataatcagattagtgcctacatttgtttacaaaggtataaccaattctagggccagaccaaacaaagctctgtttatgtgtttgtttgcaacagtgcaatctcatttttaaccatggcttttgagaatagcagcatattacagaagggctagagacagctcacccaaaggggcgaacaaaccattctacctgaccttaggaaattaatccttcaagtgtcgattgtgcattatgaaagcagccaactgtctgccagcagtgggtttgcaatcccagaaatctgatgcttttctataccttcaagcaatactaacagaggtttggattcctgagcaagaccagtctgaaagaactatatgtgggcattgctaattctttacaaagattacaagtcttcattcccaagactattccttgttctgacctctctacttttttccatctcatgtaacttcactctttcaacctcaaatccctatgcctaggcacaagccagtctaccgaaatgtgggcagctgtcttggcatgcatgggcaatcagatgtttgaagaaaattgatgaataaccatgtgtccaagacatccaaagggcttagagaattaaaagccttattcttatggttaaacactgggaatgccatctcattcctccccagtgatttctctattatcagctggaaagccaccagcagatcccttgttcattggccaggatgcaaactaacacttctttcaagtctcacttttgttctcagggttaggaacactgccattattaaaaaaaaaatctggttggtccagctaattggacttcttaggtcataattacagtatcgtgacatcagcctacattttcctggaattgattattaagcctcattatctatatctttgtgtcctgacaccaccatttaggaccaaatcattgaacctaccatactatatacaactaggctaaatgttccctaagtcctaggactatgaataaactgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagaccaaacaaagctctgcttatgtgtttcattgcaacagtgcaatctaatttttaaccatgagcggagacatgcatacatgctttaaaggagcaaaacccatagttaggcataaaaaaatcagggaccaatggattgattaatcaattgatcaattgattgatttttattgtggtaaaatatacataatataaattttaccattttaaccatttaaacagtacaattcatggcattaagtacactcacaatattgtacaaccatcatcactatctacttccagaactttctcaccaccccaaatgggaaccctgtacccattaagcaactactcctcattaacctctctccccagcccctggcaaccactaatcttttgtctctatggatttagtctttctgaatatttcatataaatgaaataatagaatacatggcttctttaatttagcataaccttttcgacattcatctgtgttgtaatatgtatcagaatttcatttctttttatggctgaattgtattgtatttatggctgaattccattgtatggatataccacattttgtttattcatttatctgttgatagacagttaggtggctcccaccttttgactattgtgaatagagctgctatcaacattggcgtagaagtttttgtttggacacttgttttcaattcttttgggtatacacctagcaatgcaattgctgagtcatatggcaattctatgtttaatttactgaggaacttttaatgtaaatctgtcatattacttaaaaacaagggctttcaactttgagttgaatcctggctttgttacttgctagttggccgacgttgagcaagtgatataacctgtcagcctcagttttcccatctgctgaatagggttgttttggggatcacatggcatgatgcatataaagtctcaacacagtgcctgacacatattaagcattagatacctgtcagctactaggaatatcctgtagtagtcttattcaaaatgttctgtatagtcagcatcacagacaagtagaggcatgaccctcttatttattttgctacttacctcatcacccccaccttgtagagctctggaagtagtcggaatttccagaaaatgatctaccctcatttcttaacccccaaattttaaattattagaattgtgcatgtatgtatgtgtatatatatgtgtgtgtttctgtatatatttatacacatacatatatacatacacacttccatgtactgtacacacaaattattctagtgaaaacatttctttaaaatctcaaaagcctgtgtgtcttttataaaaccgacactttccaggaagaggcaatgcaatttagtagttaagagaatatgtttgaatcaaaatagacatgggaatgaatgaaaattcagtgtttattagctgtgtaatattgggaaggttacctcatccatctgagcctcagtttcctcatctgtaaaccaagaatataaatagtagtacccacctttgtgactttttgtgaataatagatgggataaggcaagcattagtgctaggaacacagcaagcacacaatcttcagtctggtgctacaaagatacccatgactttgaccttccttgctttcccacacaccacaggccaccaaagtggcccacaggagttaaagagccaaagactttagctaggcctgaaagaatatcaaatggtcataaagagtttttccaaatgaaatgaaattacaccataacaaaagctgttcaagactctgtaatctcaaatgcatcctttgagtatcctgattacgcttagtctctgttggtagttacatttttctaagaggaattaactttccatctgcacagaacagtaccatatagtatttgagctgaaagggaaaatgacagtgaaaggagttaatatctgtgatactctgcactcagcttgtcttatttgatcattataacaactctgttatgaggtaaatatccttattcccattttggaactgcagaaactggggctcagaagaaacttgctcagaactaataagtgtcagaagcaagatttggacccggatccttctgaagactcgaatttactataccacacacttactttaaagaatttctgagattttcttttgctattggtgaggcagaaaccaagaaaggtaaagtgagttgtccaaggtcactcagccatttattataataataaagcaggactggaatccagttccaggaatgccatctcatgttactttattgcctctaatggatgaataatgtaatagttcatcagttaaaaatgattaaatgttgggagaaaatctgaaaataaatttcatccataacttattttcatctcatgtttcaccgaccttattgaaaaactgttttgtgtagttagaaatgaactaatgacctggtgttccctgatgtctgtgtgcccactgtattcactacttgatgttcagaagtaaataggcaaatgcaggcagtccacaggttatttcagttctagtttataaccactgtgatgggtaattttatgtgtcgacttggctaggctatgatgaccagaagtttggtaaaatactagtctaggtgttattgtaaagatatatttaagatgtgatgaacatttaaatcaggagacttcgcagtataatttgaagtcaggcaatgtggtaactccaactttataccttttgcttaggattcctttggctattcaggcccttttatggttccatatgaattttagaattgtttttttctaattctgtgaaaaatgacattgataatttaatagaaattgcattgaatttgtagattgctttgggcagtatggtcattttaacaaaattgattctttcaatccatgagcatgggttgtttctccatttgtttgtgtcatctacaatttctttcaccagtgttttgtagttctccttgtaggtatcttttaactccttggttaaatgtattcctaggtattgttttgtagatactgttaatgggattgggttcttgacttggttctcagctttattgttatcagtgtacagaaacactactaattttttcacattgattttatattttgcaaatttattgaagtcatttatcaaatctaagagtcttttaggtttttagatataagatcatatcatcaatgaacacagataatttgactttctcttttccaatttggatgcctttttttccttctattgcttaaatgctctagctaggacttccagtactatgttgaataggagtggtgaaagtgggcaaacttgtcttgttctcattcttaaagggaattcttttaactttttcctgttcaatatgatgttggctgtgggtttgtcaggtatggcttttattattttgaggtatgttccttctccatctagtttgttgagggtttttctcatgaagggatgctggattttatcgaatgttttttctgcatctattgaaatgattatatgatttttgtttttaattctgtttatgtggttaatcacatttattgatttgcatattgaaccatctttgcatacctggaataaaacccacttgatcatgatgtagcatagttctagtataaaaatagacacatagattagtggaatagaatagagaacccagaaggaaagccacatacctacaaccaactgatctttgacaaaattgacaagaatattcattgaggaaagtgccctctatcaataaataaggctggaaaaattggacagccatatgcagaagaatgaaactgaacccatatctatcaccatatcctaaaattaactcaagatagattaaatgcaagatctcaaactataaaaattctagaaaaaaaaactaggaaaaatacttctgaacattggcctaggagaaaaatttattactaatcctcagaagcaaacataacaaaaacaaaaatagacacatgtgacttaatgcaactaaaaagcttctgcacagcaaaagaaataattgacagagtaaaaagataacctatggaatgggagaaaatatttgcaaactatgcatctaatgtctagaatctacaaggaactaaactaaaaaaaaaaactaacaaataactctattaaaaatgggcaaaggacatgaacaaatgattttttcaaaagaagaaatgcaggtggccaacaaacatgaaaacatgcccaacatcactaatcaccagagaaatgcaaattaaaaccacaatgacataccttcttacagcagtctggctattatttaaaaggcaagaaacaacagatgttggtgaggatgcagagaaaagagaatgcttatattctgttggtgggaatgtaaattagtacaactggtatggaaagcagtataggaagtttcgcaaagaagtaaaaatagaactaccactactgtgtgtccagcaatctcactactgggtatctaccaaaaggaaaagaaatcattgtttcaaagagacacctgcactcatgtatttatcactgcactattcacaatagcaaagtcatggaatcaacctaaatgtccatcaatggatgtttcaataaaaagaatgtgatatatatcccatggaatgacagccacaaaaaagaatggaatcatgttttttgcagcaacatggatggaactgggggccattttcctgagtgaaatgactaagaaatagaaagtcaaaaaccacatattctcactcataagtgggagataaaaaatgagttagacatggacatacagaaaggaataatagacattggatactccaaaaagttggagtgtagaagtggggtgagggatgaaatactacctgttgggtacaatgtacactgtttgggtgatgggtaacactaaaaacccagacttcactgctactcaacatattcatgtaacacaactgcacttgtaccccctaaatctataaaaatcaataaatcagtagactttgtgtaaagcagattaccctccataatgtgggtggaccacatccaatcagctgaaggcctcaagagaaaaagactgagatcccctgacaaagtagcaattctgtctccaaactgcctttggactttagacagcaacgtcatctcttccctgggtctctaccctgccagcctgccctgcagattccagacttgctagtttccacaactgagtgggctaattccttaatacaaatataatcacgtgccacaaacaatgtcttggtcaaggacggatggcatatacaacagtggttacatagtattttaatgctgtatctttctgtacctttttaatgttcagatatatttaaacacataattacttaacatcgtgtttcaattgcctgaagtattcagtactgtaacactgcacatgttttatcctaagagcaataggctataaaatatagcctagcatgtagtaggctataccatctaagtttgtgtaagtatgctatgatgtttgcacagtgacgaaatcgcctaaggatgtatttctcagaatgtttcctagttgttgagtgacaggagtgtacatacacacacacaaatatcattttggctatattttcctggagatcccgaactaataacaaccacctactaatgtaccaggcacagtgctaggctctgggaatatttagaagagacctctgtgcaaagaaatttgcacaatatggcaaaatgtgacaaaacacattgacaaaggtaggtcaaggcgggaaaataaagccacaagaaaagcatccggggcatttcatgatgtcctttacacatgatgataactaaggacactcagacatttatctgcaagtgggaaatttatttaatttagaaggagaaaccttgcaaaaatagaggtaaaaatagactcccctctttactttagactatcctgtttgttacatctactcaataaattaattcaataaacatttattgaatcttagctttgtgcacagtgtgtaatgacatagttgtgatgatataagaaacctcagatttgccagcgtttccccctaaacttggcttaatctctggaacccaagctagggttggaaaaattacttggtatagctgtggagtgaaaacgggcacacagatgctcctgctgagaccacctgtatctctgacaactttatttgggccaaattagttgaatatatgggctggtggcagttacctgtcccctgtcttctacctcctggtttccaggattgcctactcagttttcaggctctatcagtacttagtttgcattcatcaaccatttaaaaggccagccctgggtatttcagggaaggatcatgtccttaaaatgtagtgaattccacttattcccaaggatgcaagctcttctctgactccctgcactgaagtcatttagagtcttttgagagttaagactaattaaagctcatagagtacttggagagccgtgcatgacagcacatgaatattttcaaagcggtgtcttatgcctagtatctgggccaggaccaggcctatagaatttaattgaatgtgtatccctggttaaaggtggagctccccagtagcagagtctttgtcccattctgctgtgtatccatataagtttgagccctactttctctgcacagatctttaaggtagatgttcgtcagggctttttcccggaactctttcactctctgcacaaactcatccttgcataattctacgttctatcccaaatctgtcttccaagctccaagcccatatatatatataactgtttagacatattttcctggctattcacagatatttcaaactcagcatgtccaaaaccgaactcattttctacacacgcacatgcacacacatacacacaaattggtcctattccatgcttccccatctcagcaaatggcattaccatcctccctgttgctcaagctgaaagagtcaccttcgactcctctttttccttcccttcccacaaaggttcagtcattcaccttaatccgtccatttaccaactcagaaacttaaatcccaaacataaaataaaacttaaacttaaaacataaaaaaatagaatagtacaatgaaactcctcccatgtaccaattgctcagcttcaaatttaccaattcatagacagtctcatttccaacaatcctcacttctcaccctcaatcattgtgaaacaaataccagaaataatctcatttcatctgtatttcattaagtatctcttaaaagtaagttatgaaaacatccaaaatcccattatcacaccaacaaaattgacaataatataatataatcgaatatccagacaatgttcatatttccccattgtttcataaatggatttgcttccttacatttgagtatccaaataaagtccctacattgtgattggatgataaatctcttaagtcattgtattttttaagttttattttgtttttaaattgactcataattgtacatacttagagggtacagtgggatgtttccatacatatataaattgtgtaatgatcaaatcctggtaattaacatatccatcacctcaaacacttatcatttctttgtggtaagacattcaaattcctctattctagctattttgaactatacaaaatattacttttgactgcagtcaccctactgtgcagtagaacaccagaacttattcctcctctctaactataactttgtatccattgaccaacttctctccatcattcccagcccccttcccactcttcttagcccctagaaaccattattttactctctacttctgtgagatcaacttcttttagatttcacacatgagatcatgtggtatttattctgtgtttgacttttctcacttaacataatgtcatctaggcttatccatgttgttgcaaatgagaagattttgttctttttatggctgagtagcatttctccatgtacatatgtaccacattttatttatccatccatccaatgatggacacttaggttgacttcatatcttggctattgtgaatagtgctgcaataaatctgggatcacagatatctcttcaacatcatttcatttcctttggatatttcatattcctttggaattgccagatcatgaagtagttctatttctaattttttgaggcatctccatactgttgttcataatggctttaatctgtagcttctcctcaatctctcttttttctccctgaaatatttgtggaaaaaactggatcattttgtcttgtaagtttcccacagttttgatttgttggttggtgttggcattggtattggttggtgctggtattgtaaagctttggcagttagatctagagacttaatcatattccatttctctctctctctttctctccctcttcctctctgcctccctccttctctccccctttccctctcccccttccaccgcctcttccccttcccctctttctgcaaaactatttaatcacgtagtgttttattcttccatcattattgatgtacaaaatgtctgcaatgtctgcttgatcttctttctgaaatactagcagctgttgatatctattacctcaatctattacttcactgggagttgcaaatgttgattctgtaattctgtcttttcttatgcatactgtacttgaatactttatttaggagaaacatcccttcattaatttttatggttatcctgagttatagttcatttaggaaaggcagaatgaatgcttgattccactatcctttttttaacaaatttaaaaaataattatttccctggcatcctccaaaagtgacctgtgaaaggtttttttgtgtgtaggttaccattatggattcatgaagttccaaatattttacaaatttcattgaatgcagttatcgttattggtgttcaggccatcacttatttgggcagtgggaacctattcagaatgacttctgagtccctttgctgtgtttttttttaacagtgttactgagatataactgacttatagtaaactgaacatatttaaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtaccaatagccctgtatgacaaaggtccccaacccccaggaccggttggggactgctgacatatgagatatgtcagcagtccccaaccttttgggcaccagggactggttttgtggaagacaatttttccatagaaggggccggggtgggaggtgtggggcgagggatgcttacaggatgaaactattccacctcagatcatcaggcattagttagattctcaaaaggagcgtgcaacctagattttttgcatgtgcaattttcaataggatttgtgatcctatgagaatctaatgccaccactcatctgacaggaggcagaactcaggtgctcacatgcccgctgctcacctcctgctgtgcggcccagttcctaacaggccacagacaggtacgggtctttgtcctgggagttggagacccctgagatatgtgatatgcgaatattttctctcagtctagagcttatctttccattctcataagaatatcattcaaaaaggaagttttaatttagatgatgtccaatttcttcatttttttctttcatgcttcaagtttctggtgttgtatctaaatctctgcttaatctaagaggacaaagattttctcctaatttttctactggaaattttaaagtctcaggcttatatttacatttacaatatattttgagttaatttttgtacatagtgtgaagtatagatcaaagttcatcatttgtttattttgcatattgaatgtccaattgtttcagcaccatttgtttaagacaattctttctctactggactaccactgcagctttgtcaaaaatcagttgactatatatatgtggctctatttctggactctattctgtttcattcatacttttgtctgtctttacactctcttgattgctgtagcttcacaataagtcttgaagtaggtcctgtacgtcttacagctttttctttttctaagttgtttgggctatgctaggtcctttggattttcatatacatgttcaaattgcactgagtttatgatcatcaattgggggaaaattgatatcataaagatatctttccatttatttaagccttctttaattttctcagcaattaactttgccatgcaaagcgactgcacatcttttgtcagatttattcctgttttatatatttgatgttatcatatgacatttttatttcagtttccaattgtttgttgctagtttacagaaatgcaactaatttttgtatatcgaccttgtatcatccagcattactaaactcacttattagttctagtagtttttttgtagatttcatgctatattttatatagatcatgttatctgtgaataaagacttgttttgcatcttccttttgaatatggatgccttttttgcactggctagaacctgtagcacaatgttgaatagaagtgtaaatgtggacatctttgccttgcccccaatcttagcagggaaagcattcaggcttccaccaacagacacgatgatatctgtagtattttccatagatgccttttagcaggttaaagaagttcccttctatttctagtttgctttgagtttttatcacagtagaggctggattttctcaaattctttttctgcatctattgagataatcatagttttttttttttttctttttggtctgctaatatggtgagttacactgactaatttttagatgttaaaccgaactaccattcctggaataaactgaacttggtcataatgtaccatcatttctatatattgttaggttcgattttgtgaatttttgttaagaagttttgtatctatatccctgaaaaatattggtctgtaatgtaatgctggactcacagagtgagttagaaattgatgcctcatcttcgattttctgggagaatttgtgtaggatcaatatatttattccttaaatgtttggtagaaatcaccagtgaggccatctagcccaggagtttcctttattggaaggtttttaactgcaaattcaatttctttaatagataagggactactgggattttctacttcttcttcagtgagatttggtagtttatgtcttgcacgggaatcaccaaagataaagtcttgccacagaagggcttttaaaaattagttttgcatctcactgtggttagaaacaaaaagaaaagtagatgagttttgaagtcatgaaatatggaattagagacaaaaatactggaccgctccttcgcctatggctttgattaagcccaaaaagtttaaactggagtttgaactttgcttatgacatgcagtgctttttttctagcatgatgctttttaaagtccattcccaccaaccaagtagactacttgacttgtttctattttctgcctatgagaagggattagggctgtttctcctaattttagaaatgtaggcatacgtgacaagttggtctgtcttgttcatgctgcaagcaaaatgaaaattaacttctgaaaggatttacagcttaatattgcagccaaaaaataggtaaaagtaatatgttgttctttgcaaatgaagacagaggtcctggtgtatttgctgggttttgtactttgtaggattttttttccttctgatttttccccctagtcatgagggatggattttctatgaggcactcaattttcctggttagtcttctccacatgtaatctttccccatctgtgagcaagttaaaacatcttttgccttatcaacacatgtaagccttgtagataattaacaaataacagaatttgttgtttgaatcacagataaataacaaatagatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaagaaaaagaggcttctattttaagaacattatgggcaacatttagtttgcctgtttgtgtgttaaatgtggaaatgacctgtatttgtctcctattctgtctcctaatagctgctactactggagaactacacacatgaactcaccatctgtttcaactgggcatttttagactgtgtcccactagtccaaaagacagaaatggcactgcccttaaccatttggacttaataacagaggagacaatctgccaggatatttctaacgggacacagtctctgtcctggaatcccaacccttcctatttctgtaggcttaaaaacaaaattcttaatctcccaactagaaacgttaaaggattttgttttcaacttgtaatgattttcctaaagctatcatgttataaattagcagacaggctctgtgccaagccactaaaggccatgacactcactgtatacttaaggtctagtagcaagagtaagctcacacgatgtagaaggacatacagtttctccacgcattgcgcaactgaggaaattgaggcccagctcaatcacctgaaataattttgagtatttttattggaaaactattgccacagtttctctaaagtagtcaaaaaggaaggctgttagagtgagcaacgaatacaacagtgaaacattagcagtgctattgttggaaaagacagaaagtgaaatttaagaaaggatgtgtgaattgtgtgatatatgagttctatctcagtaaagtttttacaaaaaggaaaaagaacggatgtgactagaatttcgagagaaatggatgaaacatgaaaggtattccaggaaaatggaataataataaatagacttctatgactagagggggtgacaggtggacttgcaatggtaggttgagcctaattttgagtgcccttaaatatcatgcttaaattttgaactttgtgggtaatggggagctatcaaaggcttttgagtgaagacagaacaatcacatccaagttttagaagcatatctttttatcttctccaatgatacttctcactttctccttttgactgcagttatctcctgtatcaagcttttagtttcctgagtgcaaggaacatgttttctaaatatttgtcttttttccatagtgcccaacacagtgcctttatacatagcaggtgtgcattaaagattgtctagcaagcatacagcaggcactcaataaatacttgctgagtaaatgaataaatgtaatcattgcaatgctagttataactctactttcccctcctactttggaaagcatataagaaagcaaatgagtaggagtgactcaattacagaaagaaacatgaatcccctcttaattttctgaaaaattaaggggaagaatttgtattttgactattattactaacaattatttttgacacacatcataactgaatttgtcacacaagtgtgccatgatgctacttgtagggttttcagacaaaacagatgacactcagttaaatttgaattgcagataaataacaaatatatcttaagtataagtatatccccaaatattgcatggaacatatactaatttgggacatactcatactaaaaagttacttgtggtttttctgaaattcaagcttaatgtgcatcctgtatttttatttgctaaatctgagtattcctcacatgctccctatgactagccttgggaagtgttgttctttcatagctactcagtaaattcttactaacagaggaaaaagaggcttctgttttaagaacattacgggcaacatttagtttgcctgtttgtgtgttaagcatttacttgttggatttactttaaggtctaactgggtagtactatatcccctcaggccctggttcatactggctggctagagcttttcaagtgaaacctggcatgcctgttcctcttttacccctgatgccatcagttgtttttatctatggtgtgaacacagttgagcagatgttggagggaaatggcttcctgaaatattcagaaatgtctggtgtcagcttcttccttaaaataaagtataggtgacaagtcccacatggtaggaagccagctcccacagatcacttccttctcttctcagagtctttcattcataaactcatagggagctgttcttaaaaggcaaatgcacattaaacatgggacagaacccagcttggtttaatgtgtgtttgaatgtgtgtgtgtgtttgtgtgtgtgtatgtgtgtgtgtgcccgtgtgtgtgtatgttcacatttcaatgcaaaggttttaggttttgttttagaattgctcaaagtaaagccagattctttgtattattagcaagaagttcataaacgtagggtgatgttaaacggggcctagtttaagggaagagctctaagattttgagccaaacctgggtctgaatttatgctgctccctagctgactgaccttgggaaggcaaactaaccccttgaagcatcagcttttttatctgtaaaatgataatggtaatagtgcctacctcatggtggaggtggaacagttcagtgagataacagaagtgaactacttaattaggcacataacagatgctcacggtagccattattgtgaatgtggccccaggataggtctgatctagccaaagaggcctcagaatttctggaccctgaggccactggcagggaatgaagattatatatatatatacctcagcatcttgtattatttttctcttttagatgtttggctctcttcactttgtcacttaactagcaaatgataccaactgtctgaaactcaggatgtttttttaatctggaaaatggtcatatgaaaaataattcgtttcaaaagtagttataagaattatatatgaaggttatttagaaaatgtacacacagtacaaataatattgtgaagtaagtagagtaatattgataaaaagtacccccaaataggcacctgtcaaccctcatcttttttttcctgactttttaagtttcaggccaattcctggaactagtggcagcagttccaataaaaaacaacaacaaaaacaaaaaacaaaatgaaacaaaacaaaaaaacaagagtcacacagttgaaggtatctggtttcttatccccactctgatacttaactttctatgttgaaaaagtcacttaacagctgagttttcatttcctcatctttaaaatgggaattagtcattgaatgagaacctattaggcatccacatgcacagtactagagactgtaattgtaaataataccagctgacatagattgagcgtattctcaatataccaagcacttgacaaagagcatcatcttatttaacctcactaaaccctataaagtaaaatatccctattttatagtgcaggaaattgaggcttaaaggatttccattgatttgtcttatagtgaacccaagatcttcatctcaaaggaacctaatgtctaggagggtaggtgaagatataaataaatcattgtaatgttgcatacgtgtctatgtctctacacagacacatacatctaaaatatctatttcagatttgtggtggaaaatcaaatgagattttatgtgaaagacattttgaagaaacctgaagttattaaaaggggatagtttcattatgctgtatgaaaccaggaatgagcagccatttcaacaaccatttactgtgctaattcaagacaaatttattatattccaaggactgtcttgttttgcactgtgcagagtattaacagagctaacgtctttacaggaccacaccttctttcttctgagacatagtcacaatcctaaaaccgatgcatttctttaaccccgccagagtcaatcatccattgatcctactacctttctactgccccttgcccaccgcctgtgctcagttccttccacaggaaacctagatcctatggtccataatcataatcacttctttccatatacccttgactcccttgcccctcttttcctttatcatcctcacctagcagaccccaaccttgattaaatccaactcttcctctaatcttcatatgtatccacgtggctggacaagtctaccaaaaacctcacaatattgataactgatgttcgtttaagtccatgaccaccaaattcaagtgggcccttagagctgccttgcagtcctgccacatttccctagttcatgccttctccttgctctcctaactgatcatgtcacaccttatttctccacaaacctccagtaactccttcatgttcttattctcagttgataaccttgattcttgtttcactgagaggaaaaaataagtatgttgaagagaatgtctgcatgcttccattaccacatcaactaccctacctgcatctgtatctatgtattctgccttcccacctgtcactgtggatgaactttcaattctcttacctaagggcattccatcaacttctgtattagataccatcctctcttgtacacttaaagtcatccccaacaattcttccatctctctcctgtgtcaacacatattccctcaaactactaatatatttcaatatctccaatcttaacaaaaaaattaaacatacttcttaccccatgtccctctctggctacagtgccatttcttccattcccaatacccctttagataattggctatcctggactactccagttcctcacttcccactctgtattgaaccccttgcaatctggcttttagccacactaagccactgaaatttatctggtacagatcaccacattgctaaatccattggtatgttttcatatcttgtcttacttgacctgtcaacaatttaagtttatcactttttttcctccttgctttccaggacccctctggttgttgattctttactcatctcactggctactccctctcagattccttctcaagtacctcctcatgctctcttaacactgacatgcttcagtgcttaattctagggtgtattctcttccctttatctacctccactcccttggtaatctcatctactttggaggctttttgtttttttagagagggtctcactctgtcactcaggctgggtgcagtggcacgatcagcctcaaactcctgggctccagtgatcctcctgcctcagcctcctgagtagctgggactacaggcacatgccatcacacctgtctaatttttttgtagagatggggtatcaccatgttgcccaggctggtctcgaactcctcggctcaagcgatccccctgccttggcttcccaagtgctgggattacaaattacagacacaagccaccacacctaaccccttggctttatataacaatgatagcagagatggtgatctccagataaaccatgttctctcctactctccatgttgttaggttttccagtatgtctggttctttctaaagagaatatgaacacaagagatgtatcacttccagtaatggggaattaagagcagttactaggatctgagatagtggagttgctagacaaaagcagcttggaaatccaagtcacctttggagaaggccactaagaggagctgcttgtgtcttattggattatgactctataaattgccttgggcagtatggccgttttcacgatattgattcttcctacccatgagcatggaatattcttccatttgtttgtatcctcttttatttcattgagcagtggtttgtagttctccttgaagaggtccttcacgtcccttgtaagttggattcctgggtattttattctctttgaagcaattgtgaatgggagttcactcatgatttgtctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccatttatttccttctcctgcctaatcgccctggccagaacttccaacactatgttgaataggagtggtgagagagggcatccctgtcttgtgccagttttcaaagggaatgcttccagtttttgcccattcattatgatactggctgtgggtttgtcatagatagctcttattattttgagatacgtcccatcaatacctaatttattgagagtttttagcatgaagggttgttgaattttgtcaaaggccttttctgcatctattgagataaacatgtggtttttgtctttggttctgtttatatgctggattacatttattgatttgcatatattgaatcagccttgcatcccagggatgaagccctcttgatcatggtggataacaaggtaatttatagattcaatgccatctccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtcaccaaaacagcatggtactggtaccaaaacagagatatagatcaatggaacagaacggagccctcagaaataacgccacatatctacaactatctgatctttgacaaacctgagaaaaacaagcaatggggaaaggattccctatttaataaatggtgctgggaaaactggctagccgtatgtagaaagctgaaactggatcccttccttacaccttatacgaaaattaattcaagatggattaaagactgaaacattagacctaaaaccataaaaaccctagaagaaaacctaggcactaccattcaggattatgacaaaagtgagaaatcaaactttgtgtgctaaaccattgcgatcttaagtttgttaccacaacgtagtcaagtctatactgactaaggcatcttccttgaattccagacttccatagccagctcctcaactcctccatttgaatatcttatacacatctcaaaaccagaattcctgacgcttcccaagcaagcttctccaacagttttctccatctgaataaatggcaattgcatccttgtagttgcctagtacagaaactttggagtcattcttgacttctccctttcagtcacatcccacatccaatccatcagcaaatcctagcagctctacctttaaaacatacctagaatcattttacttctgtcagactctataactgcctctctgttataaacatccatcatcctgctgaactaccgcaacagcctcctaggtggcctttctgcttctgtgcttgccccactacagttcacatggcagcttgagtaatcctccttaaaaagtaaatcaactggtgtcactcatatgttccaagcccttcagtggatttccaggggcaaagctcttacattggtctatgaaatcttctatgatctggctcttgctccaactctggctttaccatgtatcccatccccctattcactgaactccaggcttctggcctccttgctgtagccaaaacatcaagcatattctctcatttactgcctttgcacttgctgttccctttgcctagaatactctttcctcagatattcacataactcattccttcatcttctatagcagtgtttctgaaacattatgtgcatcagaatcacctgaagggcttgttaaaacatagatttctgagccccaccctaaagtttatgattcagtggatcgtggaggagacaagaatttacaactctaacaatttcccaggactgatgattctgggccaaggactgtgctttgaaaaacactgttttctgctcagaagtccccttataagcaaggccttctctgacttccttatataaaataacaacctaaccccaacacttcctaccctcttacccaatttagtttcctccataatacagatcaactgacaaatatgtatgtaatattcatttactgtttgtcttccctctaaattttaaacaccatgaaaacaaggacttggtttcacttatggctgtatgatactgccactatcacccatctctaacacagtgcctagtacatagtaggcacttaataaatatttgttgaatgaatggtgagaataaaattatacacagccagtcttctgtgacctaagcttctggagaaaattgctcacaaagataactggcctttgcaatccaatcacttcagctaagcctctgttacttcctatcttgcttcctgggttaccttttgcatcattgtcatccttgccaacccccatgcaagaaagcactggtgatgcctagaaaagcctattggttggtggtagaggcactgtgatgtaactctttatttcaggagacccaggagaaacgaagaatcccaagtgatgctgatctctaacacttgtaactcaattgttctgagagcaattatttcacagcccttcactgaatatctgctgtgacagggctgcagagaagcataagacatggtcctgatcccagtctgatggcagaatcaaattgagtaaaatactgcaaaactccatcagcaaagggaagagagtaagaactgctcctgaaattgctgagagggaggcagtgtataagggtgtcttcaccaaaaagatggttgagctgggtttaaaagaatgaatagaagttttgtttgtggtaaagggagtaggaaaacattttagacataggaaccagcatcagcaaaaggatagatgtgtggagtagagattatatttaaaatatttagcaatatttagggttatggtttagcaaaccctaacctttaaccctaattgctaaatatttttagcatttaaaaataattttggaggccgatgtgggaggatcacttcaggccaggagttcgagatcagcatggccaacatggcaaaaccccatctctactaaaaatacaaaaattagctgggtgtggtggcaggtgcctgtaatcccagctactcaggaagctgaggcagagaatggcttgaacctgggaggcggaggctgcagtgagcccaggtcgcaccactgcactccagcctgggtgacagagtgatactccatctcaaaaaaaagttaagtgagtgcagtgattctctgaaatgagaaataacttgtagtggtgatctgggggaaaaaagtacaatcttccctttatttactaggcatttttattcagtaacaataaaaccatgaaaaattcatttcaatgtataaaatgtgattatgttcttgattcagataattacatatacagacatcaacaaatccaaatggacatcctgaccaagcaaagtgaacatcagctatagacaaactggcatgatcataccagtgcacagcacttgataaggagctccagagagagaccagaatgttgcaaaaaatgctgagtagtctagtatagctaatgttaatataataataatagctgacacttagtgcatactataagccaggtactatgttttgcatgcttaatcttattgagtcctccaatcaaactctgtacagtagatactgttgccatcctcattttacagataggaaaattgggtttcagagagataaagtcagttgcctaagttcatccaactcggaaatattagagctgggatttaaacctgtacagactgactccagaacttatattcctaattaagggatactgcctcagatattggctagaacatagttttgccccttaacactgtggttttatacaaaggagtaaaataaattgacttttcccttataaacgttatggtctggatgaggaaacaagactctcagctatgcaaccttaggaacattgcaaagactctcccataacaacatgagacacttacccagtgaatgggacttagggagtattgtggttcaccgaagctgaagtggtcatggaaaatatagaacttgaatttggccttgagaggtacggaacagtaggaagaatattgcattatgttcagaagtgttagaatccacttgttaacagtgtgacccaagccaaaataatcttcttcagtgttatcatctgtaaaatgggtgatttggattagaccaatacttcttaacaaaagtacaccccaggaggtattttggaacttgtgaggccatttgtgattgtcaaaatgatcagggagtcagggacacttactaggtggctgccaggaatgacaggtgttctgaatactatgcatcctgaaggatagagaagacctctggatattcatggagatgaaaactgtttataattatttaagtctagaacataaccacattttacatattgaaatgaagtttttcatggttttcttgttacaaataaaactgcccagtaaataaagggaagattgtacttcctgccccccacccacgatcatcaccatgagttgtttatcatttgagagaatcactgcacttactaatagcaactgcattcatgatacttgaatcatcaatactacatcccagtgtcattctgtgtcagcagcctgttacattcataataattctctatagagctgttggcctctgactaccacttcatgacatcttctaatatagccatgtatgagcttttatatattgaaatacatatctttttaatataaattacttttcttctttttttttctttgcaatacagttagggcataatatgtgcttttaaaatttttgcttaattaggagatatacctaatgctaaatgacgagttaatgggtgcagcacaccaacatggcacatgtatacatatgtaacaaacctgcacgttgtgcacatgtaccctaaaacttaaagtataataataataagatttaaaaaaatttttttgcttacatttttattataacttattcctatgaatttatttttaggatagcaagggagagtaataattataataaaaataataaagtactgctcggatagagttaagaaccactgtattagatgatctcccaaagcctttccagttttaattttcttgggtataagatgggcttgatcttgagagaaaagggagagcattccaaggtggaaatgacaccagccacatggcctggtcaagcagggggtggagtgtccccagacaagccaggataaggcagaggcttctcaggtctagtctggtcatgttccctggaagcctgccttcactcctcccacctcactgtaattgaagactcctggggaaactgccagggctggcattacaggaaattgccttgtggccaacagggcttctctggttactttcctcagtgacaaaggacagtgatgatttcctgttagctgagtgtctttgcctccttgttctggcgagttcctaagaaaccttagcttctgattcttatggttttgttcagctcctgctattgttttttttttccctgtcttatccagttcccttgcttccagcctctttgctccatgcttgaggggtctggaaatttttcatctactatagaccaattttatggaacactcaaacagacattgtttggaagtaggccatagctccaaatagatgccatttcaactttggcaacacctgtcaagttctcttccttgaaggggatgacttttatcacttaatattatgtattattttgtattcttaataattatatgtgcttgttgaagactgcttagaaaacacagaaatgtatggagaaggaaatacaaattatccataataccaagaaatatagtactcaacattagacaagggtgtaagcataggtgaagataaaattcaatgctgctctctcagttctctcttgtattccagcccctagcttcctcctgccagagtacctcttgatctcacccttattaaaacttgcctgtcctatattccataaaatggaaggtaaactggaaagtgtgcaataacacttaccatgtcaagggcttataagagagataaaatataacgtataaggaaggtgtttggaatctaaaatagtaatattttgtcatagctttgccatctttaccttattaccaaggtgttgtgatgataaagtgttgtgggaatgtctaaagagataagagaccatctgagaaattcacagtgctctctaggaattaggaaaaggcacacagtacacagaggcaagaatgattaagtgtgaggtcagctcataaatatgcctttctctttggaaaaaacatccaacattaaacaaaaaagttggatggtactaaatccatcccagagataaagttcttgttacagataacagttagaatttatgttttccttttttcccaaggtggatatggtcagaatggcagtttttctcattgttgagtccttgtattgaggttctggtagacaaaggacttagaaaacactaaggcttaagggttaaggtcaagactttggagttagtcagacccgagttcaaatcctaactccattaatatagtcaccaaaaattccttgagtgtcatccatggtttcagacattggagatgcagtgttggacaaaacaatgaagtccctacttacatgaagcttacattctagtaggagtaaagagaatgtctaacgatgaaaaggtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtat

SEQ ID NO: 3614 - DNA, 256778 bp, human
ctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctg

SEQ ID NO: 3615 - DNA, 129093 bp, human
ctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaa
